United States Patent 12,790,634 (MOST PROBABLE NUMBER ANALYSIS OF HETEROGENOUS POPULATIONS) - sequence listing, part 15

SEQ ID NO: 7 - DNA, 6068505 bp, unidentified (residues 4,045,671-6,068,505 of 6,068,505)
  source 1..6068505: mol_type = genomic DNA; note = Enterocloster bolteae
cttcggaaacgtttggaaaatccgcggcgtggactgtctttgttccgcacagataggcctctgctcctaccccggtcatgccaccagcacagatgagctgcttaagcgcctggacctggccgtgtctgctgcctctgactgcggacccaaccagatggcagtatatgacagcaacatgcatacccagttcgtccgccgccaggctgttgccatgtaccttcagacagccctggaaaagaatgagctggaggtccgctaccgtcccacctataacctgaaggaaggccgctttacaagggctgattcctatatgagaatattcattcagggcatcgggctggtgggcgcagctgagtttatgcccatagccgaggattcaggccagatcagggccattggctactacgccctggaccatgccggcagatgcattagcgaactgatgaatacgggaagggaatttgactccatctgtatccctgtttccccggtgcttcttgtacaggaggattttctggatcaggtcacaaaggtccttgagacctaccagatacccaagggcaagctggccctggaggtggacgacagcgccctgtccaatgtatatctgaacgtaaacatcaccatgcaggagctctccgacatgggtgtggagctggtactcaacaacttcggttccggatgcgctcctgtcagcagtatcctggaccttcccatcaatacagtaaagctggagcgcatgtttgtatggcagctggagaccaatccaaaatcagcctccattgcaggcggactgattcagattgccagggaactgggtatccatatcatcgctgagggtgtggagacagagaaccagctgaacgcactgaacaactatcagtgcgagtatcagcagggcttctactacgctcccaccatggagcaggacgtgctcataaaggtcatgggaactacgctggatgagtccagggttaccattgaggaagagaagcttaaaatgaagatgtaacaataatccttgcaggaaataaatgcaagaaaaatatgcaagaaaacgcaggttccgttttaacggttcctgcgttttgcgttgttattgttatcattattagatattgtattacggcttccactgggcataaatggattcattgattcctgaatgtatggtcagctcactgtgtccatccttcaccagcttaactctcctgttatttttctacctctccatcggataaaccaacccccactgtctgcgaagctcatccatccaccccatcatgcgcagggtttcctcatggggcatttccgggcactccaaagctccctctttgatcgcccgcaggcatgcctccacctcgtactcatacccgctgatctgcttaggagtatcgtaggaggcaatcatgttcctggagcggtcatagacccggatgccctcacagttgttgatgttctccacctcaataaatccattgtcaccgtagattatgccccggcggtcgctgagtcccattgcgctgctgcacaatgccgccatctttccatccttataggtaatggtaatactgttctgagcatccacaccggtctctgtcatcaccgcggtaccggtgatggagtccacctcatccccaaacaccatggatgcaaaattgagcggatagattcccacatccaaaagggctcctcctgccagctcagggcgcatgatgcgctctttgccgctgataatatagcccagattggctgtgagcatatagggccgtcctatgatgccgcttgacagcacgctgtccagggttttcctcatgggcatataccgggtccagatggcctctgtcagaagcagctttttttctctggccagcgcaagcacttccctggcctgggattcattgactgtaaaggacttttcacacagcacatgctttccgtggttcaggcataatttaatgtgctcatagtggtgtgaatgaggcgtggcaatgtatacaagctccaccccggcatcctccaccagttcctcgtaagatccataggctttttcaaaaccatacgtttgcgcaaattcagctgcccttccataatccctggcagccaccgcgtaattttgcgcacagtccatctctctaatggtccctgccatggttcctgcaattgccccggctccaattatacctaccttcatcttagtaaccctcctttaatgcttttttattcttctattgttcctctgttattccattttgttccaattctttctctgagcttccggtaactacatggacatgcctgtatggaatggagatacccacggcatcaaaattcttcttaatgaggcggcgtatatcgctgcaggcagtaaaattgtcgtcaatgttcttagtccagaccgtggatttaaggatgattccgtcatctcccagttccttaaccgccacattgaccttatttccctccgacggatccgggcggatgtcaactaccagcggataagaggcaatggtctcccgcatcacctcgattgcctgttccagattgctttcatagctgacggagacttccatgtaattgcctatataatcattgttataattgctgttttccacaattgccttattgatgacgctgttgggaataatcatgcggctgttatggtaggtccggattacggtatggcgcaccgtcatatcctccacgattccggaaatgcccagactgcttatgttcaccttctctcccagattaaagggacgggaccagctgagcatgacgccgcttatgacgtccgccaggacctgctgggcagcaaaacccacgatggctactaaaagagaggagctggtaagcaaagtagcactcagcgccttagtggtattgaaaagtccgctgatgcagataaaggctatgattgtcagcacgaccttggacatactccgtaggaatttaatatgaatctgttccttccgcttcagaatcatcccgaatatcttattgagcgcaaacattcccccgctccagaatactacaatcaccgctatcttaatcaataaaatctgcattcaaatatatcctttcatatttatgtcgttcctattatgctgttctttaatacagtttctttaatacagttcctttcagtaccagtcatgttatgtaccgcaggctgcattagtagtctaccataccggcccccttcttgcaatctccatattcataccagctcccgtgtctgctccgtgcctgctcccgtgtctgcatcctttatccgcagcctttatcccccgtccctatacgtattcctcctatcatcaaaactccctgattaccagctccgtaattccctgattgtctcccatctcaattcgttttaccgccggctcccttccgtaaccgtattcctcacggagcatgctccgaatccgcgtgccgccgttatatccgtgtatgacacgaatccggtaaatgctttttcccgcagaatgtatctgcatattgattgcctttttcgcttcttctgtgttttttccgtgtacgtctatctctatgattccgcccgtcatctgtccttcattcctcgcttcttttgttgtcaaacatactgtccgtatgataaatacatcacaccataaattttaaatcaaacacgatggcccttgccagctcctcaggcaccgcctcggcctcctcagccaatacctgcttaatgaaagcagcctgcttcctgtccacccttgcatagagacttctgatttgcagcgcacccagcaatttatccctgtattccttcagagactcatccttcagcaggaaaatcagatagggcaggcggtcccaggaattctcctgtatgagaaggagtatcaggtatcttctgatgtgacagacaaaatcctgggactttcccgcagtctcatctgatttcctccatttttcctgctccctgtaaagcagagctgcgccgggatgtatcccgtttttccggatgcactgataagcagccttggatatacagggcctggtatcaaggagatacttccagtaaatttcttccccttctgcccccatcagcatacccacggcttccagagcgcccctgaccaccttttcagattcgtgctccagatacggaagaacaaggtccgccaatccatgcctgtcatccagcgcccttccctgttccccgattcccaaaatagccggcaccgggacaggctccttcagatgcttctcataaaatgccaggatatccaattggctgtgctttttaagtatgtaggccgccagatcccgtatgccgcagttggcatccagcagcaaatcctccacacccggccaggcgcatttcagaacatgatatttatactccatagcctttctcctgacaaaagagctgcggtgcagcaaataacagtcagccatttccatggagcacgggtaatatgtaagcagccctgtccatatgacggactggcagtagctgtgtttttcctggttgagaaatagttctgccgtctcctggtccagccttctgccgctgaacaggaatcggtatatgctctttctcacctcataatccatggacagaacggatggcactgacagggaacctgcctcctgatccagccgttctgccatgattgttccaatgtgttccacggtccggccgtcctttctcccggagcgctttaccttatccagggccatcatggccgcaaacacttcatccagaggacatgtctccagacgtttggctgctgcacgggcagcagccaaacgcacttcgcccacccagtcattgaggcggagcacaagaaaggggagcgcgccaggataaccagccatctcctccagacaggcctggcggtaatagccattgggatggaagctgcccagggccaatatccaaaagtaatccctatctgaccggaaccagtctttcttctgccttatatccacatttttccagtcaatatcccattccatagaggtatactgccggaaatgttcgctgagccgtatcacctgcctcatggtcataccctccatgaccatccctatggcccttcccccgcttcgtatcaactcccggtcctctgttgccgccgcacagtacacctgggaaagaccggaaatatccattgcttccagtccggatatggcctgggacatcctggcacggtatgcccttttcagccgttccttctcaacttttgtccaaaacatggaaaacctcccttctaccctgcaaaaacttccgtttctgcactgtgcccggctacagaacctccatctcctgggccttttccagccattccatacaggccctgtgccattcctcccaggcctgttccagacgcaggcaccggtcctcatattcattcatccgatcccaggcacctccgttccaatacgcctctgacccatgccacatggcccgcagttccttcacctgctctgtcagatattccactgcattcccggcaggttccagatattgggcggccaggcccatgttccattcccggtatgcctcatcctccggtatttcccttagccggtggcgttccgctttgggcacggcgcgcatacctgctatcagcgcctgctcctcagccctgatctgtgctgccatggaaccgccatggttctccctggccttgcgctccagatagtgctcatatccaaagggataatacattacggtttgattttcaaatatcatcaccgcatctgccacctgccggataaaatatctgtcatgggacacaaacagaatcgtccctttataggcccggaacgcggattccagtgtttccttggcctggatatccatatggttggtgggctcgtccagaaccagaaaattgggacggctctgcaaaagctcagccagcaccagcctcgccttttctccgccggacagagaactgaccttcttctgcgcgtcccttcccccgaacagatatgcaccaaggatacttctggcctccttctctgtcagagcagggaattgggccgtaaaatgctccagcacggtctgctccgactggatggccccgctgtgctggtcaaaataaccaatggtggtctgatttccaagggaatagctcccttccagagagggcaggaaaccggcaatggtctttaaaaatgtggtcttacccgctccgtttggtcccagtagcgcaatcttctgtccgcgccgtatgcgcatggtgatttcaagcagcggcttttcatatccgattttcaggtgctctgaagtgaacacccacttgctgccgggcagaagaggattaatctcacctgtaaagatatgagcatcatcctcctgaggtttttccacacgctccatatgctccatggtcttacgctttgccctggcaaatgcagccttatttggtttgtgcttaaaccgttccaccagattttccaaacgggccagctcctcctgctggcgctcatatgccttcttctgaagccgaatctgtttcagcttttcttccctgtaatgggtataattgcccggataccgcctcagtccttttcctgtcagctcatacacaacatccgcggtctggtccagaaaaaaacggtcatgggataccattaccaccgcgtttttataatgtttcatatactgttccagccatccggctgtctccatatccagatggttggtaggctcgtccaagagcagtatatccggcttttcaagaagcaggcggattaaagctatcttggtctgttccccgccggaaaactggcttatccgctttttcttatcctccttcggaaatccgaaaccagtaaaaagcgtgtcgtactcacgctcatattcaaaccgttccctttcaaaggtatcccggcagggacatgcctccagaagctcctcctccatggtccggttcccgtccttaaaggcctgctgggaaagcatcccaacggtgagccggcgcgaacaccgtatccccgccccttcgcgtctgtcatcccggtccagagaaagcttccctgccacaagatttaacagagtggttttgcctgctccgttcttacccaccactgctatcttttcattgccgcgaatctcaaaatcaatgtgggataaaatcagctcgccgcccactgatacggtcccgtttgaaatctggtataacatgactgtgtcctctgtctgtgataatatagttaaatctttctggtgatgtgattatcctgccattttctctggatgttatctgtattatatcatgacgcgcctgattgtagtatcaaatactttatcttcctttcccggactgctttttgcggatttaaccatataggtccgggaaccagaatcatgttgccatgagtcaaaaaagagaggtcaggcaagccctcctctctctgtccgtcataccagctggttatttctttttatctctgtcattaaatgatttaagcaccatctgcgccggataacaataggcataaatacagctcttcataagctcctgctcctgctggttcttacatacgctgagaatcatctctttctcatccgcctgcaggtatgcttctgcgctgttgcctccgatttcccgtatctccttgtaaatccgatatttcttgtaataatccaaaccgccgaaatactttgccttaaccggctcaggtacaatattcagtttatacttgtcagacatccttgccagtatattatgtatcttctcacagttttccctggtattgttcaaatcaggcatgcagtacaaatagtccatatggaaccccttcttctgtaaacaaattctgatgatattatgacagatttttcctttgtatgcaaggggttttttaagccgtgtcaaggagcatcggcataaccggcttttggttccgttttttcccggagcctggcggtaatggtgtgttttattgtccggccgccttgggcttgtccaaaacgcctgcaaaccagaattacccgggagtttgacagttgaatagagagaaaaaacctcgcaggcattgaataacctgtattttttatgtcaaaattttagttttattatattgtaatttattgcaatatattatataattagaagtaaggagggatttcccatgagagtgactacttctaaatccaaacattctgagtctttttacataactaaaggatttatcaatgacaaagggaccagcacctctgttgtcatccggaaactcggaaccttatctgagctcctgaaagaccatggcccaacccgggacgatgtgatggcatgggcaagggaagaagcaaggctggaaactttgaagtataaggaagaacttaaaaataagtccgttcagatcaccttccacgcagaccggcagctggattataagaagcaaaccttcttcagaggtggctatctgttccctcaggctatatactacggcctgcagatgaacaagatctgccggaaattgaaggccaggtataagttccaatacgatatgaatgccatcctttccgatctgatctacgcaaggcttctggaacctgtaagcaaacgggcctcctttcaactagcctctgaattcctggagaaaccatcctacgaactccatgatgtctatcgcgccctggatgttcttggcagcgagtgtgactttatccaatcagaagtctataaaaacagccacttcctatgcgagcgtaacgacaagatcctctactatgactgtacgaattactatttagaaatcgaacaggagaatggcagcaaaaagtacggcaagagcaaagaacaccggccaaacccaatcattcagatgggattgttcatggatggggatgggatgcccctggccttctctcttttccccgggaacacgaacgagcagaaatccttaaagccgctggagcagaaggttcttgacgaatttggctgccagaagtttatctactgcagcgatgcaggattggcttctgaagataaccgtgcatacaaccatatgggagaacgggcttatatcgtgactcagtccattaaaaaacttccggccgaggaccgggcatgggcgctgaacaaacaggggttcaaacgtgtttctgatgataaaccgatagatatcagcctgattccggaggatgacacaggcctctactataaagatgagccttatacgactaaaagactccatcagcgcctgattatcacctactcacccaaatatgcccgctatcagagaacgctccgcagccgtcaggttgaacacgcacagaagatgattgattccggaaagacaaagaaggaacgccgtaacccaaacgatccagcaagattcatcgggaccatggcagtgactcaggacggagaggctgccggcatccataagttcctcgatgaagaaaagattgaatccgaagctcaatccgatggactctatgcagtctgcaccgatctgttggatgatgatgtaagcggcatattaaaagtgagcgaaggccgttggcagatagaagagtgcttccggattatgaaaacggatttttccgcacggcccatttatcttcaggaggagaaccggatcacggcccatttccttatctgctttcttgccctgctttcttatcgaattttggaaaagcggcttggctaccgatacacctgcgaagagattttgaataccttaagagccctgaacttcgcagagattcaagaacagggatttgtacctttgtatgagagggaacggattacagatgaacttcacaatgtttgtggctttcacacagactatgaatttctaacaaagagccaaatgaaaacaatccagaaaaaaagcaagggaagggaataaattactatacttcaaaacatacaaaaaaaccgctgtaatgcctatatttcaagggctacagcggtttttctgtcagtctaactgtcaaagacgggattttatgacagatttttcctttgtatgcaaggggttttttaagccgtgtcaaggagcatcggcataaccggcttttggttccgttttttcccggagcctggcggtaatggtgtgttttattgtccggccgccttgggcttgtccaaaacgcctgcaaaccagaattaccctaacgatatttttcgtatccgcactgttcttttacttcttttcctaaaagcgtaattgcctgttcaggacaacggctgatacaccggtagcacattgtacaccttttacccgcagctgcttttccgtttttcatagaaatattttccattgggcataaggagacacaaagcccgcagccaatgcagcttttattgattttcagcttatccgtgtaatctgctgtttttccgtaaaaccaaagacgctgccccaaaagacctgccaaatgggaaatgaacgttataccgtcttttggatatatcccctgttttataagcagcgcggcagattctatctttttatcagcctgaataatgatttctctgttttgtttaagcgtctttttcagaagcttactgtcgcatactgagtccggcatacggatatgaagtccgcccagaataactgcaccatattttctgagtaatcttgcggtacagccagcgccgtcaccgctgaacgcacccattgttgaaacacataacagcttttttcccttccacagaccggcatttctgtgtataaaatccctgaccatataaggtgcgtttgaaaactgcgtaggatatcccagtataatcgtatcattatttcgtattgcctcaacggtcccccggctttctaaaggcatggattctgcggaggaatccagtagtcctgttaatttttcaatgcaatgcctggtgtttcccgtaccgctcagatatattccgatcaattctatccacctcgtaatgttcgatttcacattctgctttctatcatttggccgttcattatatcagggattatgccatcccgctttctccggtaaattataccatattagggtgcctccggcaaccggcatatcaaaacggaaacagttgtggaaaacagggcgccagactaaatcaaattttgagaatttatttgaagtatcctcagaggggcagatattatttcatgctataaaataactgacaatatgattgaagaagcgatcccctttaaatatctggtcacaaaggaacagagctgggcccaggcaaagcagatagtaacaatcgtcggtttgatttttctggtactcattttgctggcggttgtaattggttttgttttaataaatacccttggctaaacatggttcttatttaatcggatgcctgataaccgttttccatttttctggcgcagtctttcttgcatcagtcatatatatctcatgatggagccgtttactgttcatatcatttacataacctttttcctgtatgaatttatccataacggccacagatgcaggctcgtcatcaaatgcacccaaatgcatcatctgaacgcacagtccctcctcaatggttaaaaattctgctgatgaacaatctatctttttctttttttccgctgtctcttttgcccaatcaagatcctttttcgttacaaagtccggcaatcgaatagcggaaatccaatgaaaggaagacttatccgaatagtctgccccatccacattatcctgccaccaaaatccttcaagaggcggaacaacatattcaaaaaatccttccattttataatctgtcttataactcattttcaaagtataggccactgcatataaaatccccagcgcctgctgatatgcaccgccctcttcatttggatttccttttccccggacagctatataatttaccggtggtacggttatgatttcaggtttatgtttgggcatataaaactctttatattctttcttaaaatcaaaagccatggctcattttcctttcttaaaaaaaaatactggttttacaaacagttccaatatatgtctcctcccatacatgtgccgtatcctcatacaattactttcagtataacaaaaaagccgtttgaaggaaagcattgtatttaagttaaaggaggagcctaaaaggaggagccgctccccctctcttgttgattttattcagctcaccgtatacaattagagaagcggtgtttgaaaaggaatacgattacgatgttaagatccaacagctgattggctactggaccttaagggaaaggaaccgataacagatgaaaagactttttttgctggaagacgatttgagtttaatcagcgggctttcctttgctgtaaaaaagcagggatatgaaatagatgctgcccgtaccatactggaggctgacacattatgggcaaatggatcctatgatttggctattctggatgtaagtctccccgatggttccggttttgatttttgcaggaagattcgccgtatgtcaaaagtacctgtcatgtttcttactgctgccgacgaagaaacagatattatcatgggacttgatatggggggtgatgattatattacaaagccctttaagctggctgtatttttatcaagaattaacgcacttcttcgcaggagcgaaaattttaatacagctgctgcagaaatcaactccaacggcatccatattcagcttctgaaaggaacggtatataaaaacggaaaacggctcgacctgacagccagtgaatataaattgttatgcctgttcatggaacatcctgaccagatactttccccagaccagatattaagcaaattatgggattgcagcgaacaatatatagataacagctcccttacggtgtacatccgcagactccgcacaaaaatcgaggacaaccccggagcgccggaaaggataatcacggtccgcggcatggggtataaatggaatacagcagactgaggtgttatgatgaaactatttgccaaccgaaaaatcaaatttctttttgccggtattttgtggtccatcttagcttttacattgatttcagcactgttagcaggctttgaggtcaggaatgcgtcgtattgcatcctatttagcagcctgtgtatgggcgctgtaatattaacgctctgtttccggtatttcagagagcagcatacaatcatggaaaaagccatatcacagataaaggaatctatttccggcaacaaagatgttaccattgagtgtaatgacgagggtgaactatacagactgttccatgaagtaaactctttggtctctatcttgaatgcccatgctgtaaatgaaacaaactcaaagaaatttctgcaaaataccatatcagatatttcacaccaactaaaaacaccccttgccgccctgaatatttacaacggcattatacaggacgaaggaaaaaattctccggttattcaggaattcagcctgctttccgagcaggagctggaccgcatagaaacactggtgcagaatcttttgaaaatcacaaagctggacgcgggtacgattatattagagaagtctttagaacatgtgtccgaactcgcggaaaacgtaaaacaacatttcatgtttcgcgcccaaagggagggaaaagaaatctgcttatccggcagtggagaaattacactattatgtgaccgtacctggatcatcgaagctatcagcaatcttgtcaaaaatgcccttgaccacactgaaaaagacggttttgtccgtatcgaatggcaggcgtttgcttctgttgtccagattaccataaaggacaatggatgcggcattcatcccgaagatttgcaccatattttcaaacggttttatcgaagccggttttccaaggatacacaaggaatcggtcttggtctgccgttagcaaaagcgattgtggaagcccataacggtacaattgaagcagacagcacattaggcagcggcacctccttcacaataaattttctaattccttccaaattctaattcctacaaaattgtaggcttacagtcatattggcgtaggattgctctgttatattgggattatcaaaacagaaagaggcgtttataccatgaatttattagaaatcaaccatatctgtaaaacctacggaaacggtgacgccgctgtgcatgcactcaggaatgtaagtttttccattcccaaaggcgagcatgtggctatcgtcggagaatccggatccggaaaaagcacgcttctcaatatgataggcgctcttgatacacccacatccggcaaagtaatgatttgcggcaacgatatcttttccatgagcgaccgcaaacgtaccatattccggcgaagaaatataggtttcatctttcaggccttcaaccttataccggaactgaccgttgagcagaatattatctttccggtgctgcttgattaccagaaacctgacaggcagtatttagaagaactgcttacaatactcaatctgaaagaacgccgcaatcacttgcccagccagttatccggcgggcagcagcagcgcgctgcaatcggacgcgcccttattacgcgtcctgcgttaattctggctgacgagccaaccggaaatctcgacacacaaaacagcagcgaagtaatcgcgctcctgaaagaggcgtcaaaaaaatatgaacagaccattattatgattactcatagccgcagtattgcgcaaaccgcagacagggtattacaggtatcagacggagtccttactgattttgggaggtgccgccaatgaaaagctatctaagtcttatccctatctccgcaaaggtaagaaaacggcaaaacagcatgacacttttatgcattgtatttgctgtctttttggtaacggctgttttcagcatggctgatatgggtgtcaaaatggagcagacccgattgctggagaagcatggaagcctgacccttcaggacctgctaactaatacaatgacccaaaccctttttctggcagcaggtgtattgtttgtgctgatattgacagcggccgtattgatgatttccagcagcatgaacagcaatataacccagagaacaaagtttttcggaatgatgcgctgtcttggtatgagccggcagcaaataatccgttttgtgagactggaagccctgaactggtgcaaaactgctattcccgcaggcgttgcgcttgggattgcagtcacatggtgcctgtgcgctgccctgcgtttttttgtcggtgaagaattctccggcatccctctattcggcatcagcatgcccggaattgtcagcggaatcgttgtgggtatcgttacagtattactcgccgcaggagctcccgcaaaacgggctgcaaaagtatctcctgtcacagcagtttcaggcaattcacaaaatgatggtaatgtacaccacacagtaaatacacacctgttcaaagttgagacagcgctcggcattcatcatgccctgtctgcagcaaaaaacctgatacttatgacaggttcatttgccctcagtattattttattcttaagtttttctgttctgatcgattttgtcggctatattatgccgcagtcagccggcacatctgatttgaacattacaagtattgacggttcaaatacactcagcagtgatttgcctgatacaatcattggaatgcatggggtaaaacgcgtttacggacgccgaagcagttttgatgtttccgcaggattacattcaggtggggttaagattgatattgtctcttacgatgactttgatttggactgccttgttaaagacggtatgctgaaaaagggcagcaatatttcaaaggtatacggaaacagcaaatatgtgcttgcggtctgggataaggacagcacattggaaatcggagataaaatagatgttggtaatgaagagcttgaaatcgcaggcttattaaaatataaccctttcagcagcaacggtcttacaaatggagaaataacccttattacctccggcgctgcatttacccgcctgactggcatcactgactactctctcatcatgatacagacagcaaaggatgtgacagatgaagatgtaacagcaatccgcagcatattagaccaaaactgcgtattaaaggacctgcgcggccagcacaattccggcacttattttgcatttgtattctgtatatacgcgtttttagcaatcattacgctggttacggtgttgaatatcgtaaacagtatttccatgagcgtatcctccagaataaaatcatacggagcaatgcgggcggttgggatggaccaatatcagattacgaaaatgattgcggccgaagcctttacctatgctttaaccggcggccttgtgggctgtgccgccggtttgctgatttataagcttttatatgacattctcataatctctcacttcagctacgctgccctaagtctgcctgccgcccctttactgataatccttttctttgtttgtacggcagcgattgcagccgtttatgcccctgcaaagcgaatgagaaacatggaaataacagaaatcataaatgaattgtagctgcgttattcctgggttaagtccgggattggccggtatggagactgcgaaacagggaaaccattttccgtaagtttcgcagcttcctgcctcgacctcctgtaccaaaccatatcatatggttttatctttcgcctttgccgttcccggttttgtgttctgcgaatttgtcaatcaattcaaccttagacgttctccccatccactcataatattgacgccacaacgccaatccctgtaaagggacacgctctttgcctatggtgatatactcagtaatttggtcaggtttaagagagcaatcgtgttccatgccgttatctactataacaaatccagctatcacatctatttccacttcatccacggtaaactctataaaggtcctggtcttatattgaggatcagggctggcagcacccatagttcccatgttcaaaagaatgtttttacatcgttcaacatctttttcatcaaccatgatgtcgatgtcatgaaacacctctgccactcctttaaaatacaaaagcaatgatgcgccgatagcccataaaagattatctttgttaaactctgctgctattttttgtaatacatccatctttttctgaagatcattcacgtttaacctccccttgtagattattcttaatctgccctctgcaatctattccctcaatcctctctcggtctttcctttccatccttcaatattgctcatggtttcgtaaccatattttgtctccataaataaattatatcatatggcgggtgtatgcagcaacagacagatagggacgttgcggaatccaggcggccatgctatacttttgttgaagccaggcgttcaggcagtgcggctgatgaccgccaccaaacgtatgcaaatccgttgtggaaatacaagctatttatgataaggtatacccatggctgaatcacatttgaaaagaggaaccatatgcccgtattaatgaaagacaaatattataattacgattcgcttcacgatttggcttcacgtattaaagctgtctttccctcattccaggaaaatgattttgtggaccatattatgaacgaaacatgggatgcattggaactgaaggcccgtatgcggcaaatcactattaatttaggaaaatatctgccgccagactataaacaggcactgggtattatcgatcaggtcgttgccgggtatccttcagggtataacgattatgcactcatatactttccggattttgttgaagtctatggacaggatgaatgccattgggacttgtcaatggccgccatagaacgatataccccgctttcaactgcggagtttgccgtaagaccgtttattataaagcaagaagcgcgcatgatgcagcagatggctgtctgggccaggcatgataacgagcatgtgcggcggcttgccagcgagggctgccgtcccgccctcccctggggccaggcattgaccagcttcaaaaaagacccgtcgccggtacttcctattttggagcagctgaacacggacccatcactgtatgtccgcaaaagcgtggccaatcatttaaatgatatttcaaaaacacatcctgacctggtaacaaaaatcgcaagagattggtatggcaggcatgagtatacggattggattgtaaaacatggatgccggacactgcttaaaaaagggaatcgggaggtgctggatatcttcgggtaccacaatgccggttccgtggatatcgctgattttgcgttaggcgctgcgtctatttcactcggagaaaatatgacgttttcgtttacagtttcggcaaaagaaacaacaaaggtgcggctggagtatgctatgggctatgtaaaaacaaacggaaggcagagccggaaaatattccagatatcggagattttgttaaaggcaaaccagaaaaagacatacataaaaaaacattccttttcagatttaagaacaaggaaacattatccgggaacacattccgtcacgcttattgtcaatggcgctgagcaggataccttggattttgaattgacaatataagtatgggctttatttattaccgcagcataatgcttgataaattcagattttcggaggtaaatatgatacttgaaacagagagattatatctgcgcgagatgaatcagtcagattttgactctttatgcagcatcttacaggacgaggataccatgtatgcatatgagggtgcattcagcgatgatgaagtccaggaatggctggataaacaaattttccgttatcaaaaatggaactttggtttatgggcagtcattctaaaagaaaccaatgaaatgataggtcagtgcggacttacaaagcagccgtggaaagataaggaagtgcttgaaataggttatcttcttgcgcggccgtactggcataaagggtatgccatcgaagcagcaaaggcgtgtaaaacgtatgcttttgaaatattaaaggcagatgaagtctgctctatcatccgggatacaaacatagcttcccaaaacgtagccataagaaacggtatgacaatgaccggcacatggacaaaacattacagaggtgtggatatgcctcattaccgttatgcggtatcacgatgatataagccaaaattgtggaaggcaggccggcaagatttccatgaaagaacagacagtaatattaaataaattggattagcaattggtatctttcgcccggctttatgagggataatagcgcctcctgtcccaaatatccgttgaaaccgcaagaccgtggaaaccgttgtggaattcaggggtccatgctatacttttataagtggaaaatgtttataaaaaaatcgtaattcggaggaaatacttaatgaaaaatgtgcttattatttcaggtagtcccagaaaaaaggggaattctcaaaggttatgtgaagaatttaaaaagggagctgaggataaaggaaattctgtggaactgattcggttagcagaaaagaaaataggattttgtaaggcatgcgatgtttgtatgaaaaataatggcacttgtgttcagaaggacgatatggctgaagttctggaatcttttaaaaaagcagatgttctggtattagcaacacctgtatatttctacggtatctgcgctcaaatgaaaacatttattgataggacatatcctatatggcagcatttaggagaaaaagaagtttattatattatttccgccggtctgggcgaagacatagtaaaacgttcattaggtgatttggacggttttgtcgagcatctagaaaagtatgagataaaaggacgtatttatgcaacggatgttatggatgcaggaaaagtctgcggaacgccttacataaatatagcttatcaaatgggctaccatatataagcagttgatttcttgctcgcagagacagatttaagccccatgctggaggccggatttggttcccgtgatgaatgtcattacttgattggcatatgggactatagcgaacttggaaatcatgaaatggacttggagtgaatgatatggggattttcaagaaaactttaaggatgatttttaagaaaaataatggtagtgagaagaaacataataatacgcttgaagaggatattcatttggcgtcagattgggtggttaaagcgctaaattcatccggctacaaggcagactattctttagaaagcatgaaagaaatcgacagattttttgatgagcagagttcggaaacagggctgctttcaaaaaaccgtggagaaattttatttggtttagcttcatatattggagattcagctatcaaattatatggtggagaatggaatactgatgatagcgacccacagggagagatacatatttctgtcaagttagcgaacggtactgtcatttggcctgttatcagatgtatgaaacgatatgaacatgggtctgaagaaagtatttatgcctatctttttgttctaaatagttaatctgtcggagcgtcagcttcccatcaaaggtaaagcctctgcttctattggcagggacgggaataaagaagcagacgccaacgtgattgagcgccccttggatgccttcaatgacatagaggatgccgctatctgcatcacaaaacaaagcttgtatcggaggacagattatgaaacgaatgggtaaaattattatggctggactttgtttgggactgccgttactctttgtaaaaatagtatttcatatccccgatgacgtattttggaagtattatctgatttgcggaggaatcgcagttgttggcacaacagcattcaacattctctacaaccggcgttatctgaaaaagatgcaagcagccgcacatctgttggaatccaaccgcgcagaggaatacatcacagaagtggagtcaatgcgccgtctcgccaaaggtcgctttgcaatctgcatgctaacaatcaatttgtcagcaggatactgcaaactcaaacaatatgacaaggctgccgaactattggaaagcgtatcaaatgtgaaactgtccggtgatattgaattggttcaccgtctcaatctctgcctttgttacttctatcaaaaacaaacaggccgtgcaatgacgttgtacgaaagcagccaaaggatatttaatccatatcggaacagcaagttatatgggggaaatatcgctgtactcgatatttatgcagcaatcggccataaagattatgcccgtgccgcaaaattgctgcaaacagccaggagcacatgggataatcctcgtttcttagatgactattgctatttggaagaaatcattcatcagccccaatgaccttgaatacagtaacaggtgacggtacggtgaaggaaatacatatcatcagcgaattttcagatagataatatggtatcctttaaaatggcgtggccccggaagctgtaaaaggactatcaggaatagggaatttaaccagatgctgtattttggcgcaccgccgggagctgaattattctatgaaaagtacggttgtcaaaggaacctgcaatccttcccaataagaggtaaaaatgacccattatacatttgaagagataaaaagattgttattataaagcatccaagaacatgattttgaatcggaattaagcttgtactttaatgacaacccaaataaatacataattataatttatgaagaccactgcccctttcaacggtgcggcaccccaaaagaagtaaacggcgagtataattatgaatcattggatgaattatataaagcccagcagattgatggtattgttttgttactggatgtgaataagacggaatacattataaaatttacgaggaactattataccgcagccggcaatgccatcatccaggccggctactcttctattatcaatatacccgcaggcatggccggggcgcggcgttgggcgtaacagcatctgcattgcagaaacatataaaagcatcgtttgctgacggaacattttgtcctggaaaatggaaacattacgacgtatatacgcaaagccgcataatagatgtagtgtcgttagctgcgcccaaggtattgcgcaaataaccttggccccaggaaaccgtttcatacgggatatgttattttatgaagggaatcacacaatatgggaacgttcagaaaaatcgtagtggacaattcagaatatatgtggcttttccgatatgacgattatgattatcaaaggattccatacctattgataactgcaaaagcgttccccaaagctaccctgcatatcaatttcccaatcaaggatcacttcctgttcaacagcggcctccccgcggtttttcagggacagcgagtgagcataaatttaaaccagccattgttcgtttcccagataatacaacagtgcggtaaacaggtagatatatccaacctgaccggttatcattatctgaatggaatagatatcttaaaaacaatcggttatgaattgttttggtaactttcagttcatataggcgttaagcaggattttatttggtaatttgtgagttgggatgaggactatcacggggcagaatcccacaaaaaagctgtaattgaagcaattttgtccatacttaacacaaggcagcgtgcaggcaacaacataaaacatcctcttttttatgtgcatgaatcagacatgcagtgtattaaatgtgacgcaggtgcgttcttttatgaggataacagaggacggtttaagaaaggagtctctgaaacgccagagaagatgaaaatgaactattggcttgctttttcagagccgccttacggtatcccctacagcaaagaggactttcgtaaaatcaatgattcactatttccgataccgtttagaaaggatttggagatatttagctggaatgatgaattctcaaattattttgatgatggtaaagaatggtagggtactgctctttggagtatatacgataaatggatgaaccgtttcgtcattatcggagcttctttgacagactaatagtatcaaaccggtggtaataatgtgcagaatcagctaaaagacagggggcccatatcgtatgtgagggaagcgttagggttttgtccgtatggttttcacatacctcaggtctcttatttttgactcctttcagcctcaaaaacagcacatatataacagaaatctgtctcccggccctctgtctcctgcttttaattgccagattaagaacaccacatcggaaggacagcttgcgaaaaaacggcagaaacgccgtcgtttttcatgttcttgtatgttgaaccgacaagaaataatcccatgtacaataggtatcgtcatgttctacctggattgaataacctgcacccgccaggcactggttgcaaagttcaattttttcttccaggttatccctttcatctatatccacatatagatcttggagatatgctgcaatgctttggaattcagctttcggcagttttttctgcaggaatgccgcgactttttcagtgacatcttcctcatatccgcctatctctaataattcaccctgtatgactgaataatacagccagaaaggggcctcctctaaggaatcttcctcttccagaaagtcctcaaactcccactgctcttcaatcccaagcatcaggtcaatcgttggcttctgggtccggtagagttccatataatcctttgctgtaaaaagagcctgaatgcactgtttttcaaccatatccatcgtttatcctccataatccatggcagatagcctggattttgtatgcccttgtatatttagaatcctgggtcaaacaccaaaatgtatcatatatttctccttacaaattgcctcgcctattttatcggccagggctaccagctgctcatccctgttcatccttccatccgccatcactatctcctggaatgcaggaagtgattccggcggtatcagggtaatcccccaccttgccagcccaaaatccggacggctaaggttatggaaatatgtcttcaaaagggccagcttatcccaccagtcctctatgtaaacctcgtcatctattggaacacaatggtattttcccggattgtacatatactcccttgtttccgtaatatcttcaatgattccgaattccgcctttgccatgccagcaccttccctatatactctgtttatgtgtcctgttcctcttttatccatatggatattcaggctcgatttcatgatgcacatcaaacggttcaagtctgccaagcattttccatatatcataggcactcccggccgcaatcaggttccgcttctgcgtcaatgccccttttgcctggagataattcacattcatggcctttgcatatgccttgatttcctccaggctgcagccatccccccttaaaaccagatataaatggtattctgtcgtatctgagtgaatcgggctgaaggaagtgacagcctcccccagattttcaaaacaggaaaggaaaacagcttctggtaatgtaattgtttcccccaggttgtccgttaccttccttgcgtcaattatgtaatcaaatgcgtaatccaatccaaccgtgaaattcccatatggaggcagctggcggcaagtacacatcgggcaacggacacattcaaataaagacttgccttcgtacctcatatgcgtacctcatacgcatgcttcacatgcagtacatggatggcagaaaaatcctcaacatccatccggttatgccctaataaatccctgatatgttccggcagcctctcatattccaatggcctcagcggggcggaacgttttgtgtaatactcatggagtgttgcaatcccgaaccttgtgccgtcatccgaatcaaaataatacagccctttgtcagaaaatccccttgcgacctgctctgcccgttcgattgatttgaagaacaatgagctgtctgtgattttttctattgtgtcaaaatactccatcagttcatccgtcctctccgcatcctcacacacaaactccggaagatatccttcccctgcactacagaaaacagctatatttccattcctgtctataccgtaccattccatatccatacaaaagcattcgcttctatctattcttgccatgtattccccttatcaatctttgtcgaaccacgcaaccaattccattgtgtttttcggcttggagccatcataatagttcacatcctctgtcagcccggtcagccggattttcagacgcttcccatccacctcaataacctccattttattatccatggtaggctgatgctccatataatacaggtttccgtccacatcttcctcctggttaggctgctccaggcagaatcccggctccaatgaatctgcagggattttcagcgaatagaagtttacctcccatgacggctccgcttccagatatgccgtatcctcatgcaggccatcccccatgccgaaatctatttccaggcacagcatatccggggcatcctctgtcccatcgccctctatgatattccatgttgctgtttccactggataccgttccatgccacaaaaacgggttaaatataaaacattctcttccacttatattctcctttctgcactatcttcaaacgaaatcaaatctttttcaaaatatcgtttgcttttaattttatctccaatcctgattctgtaataaaaacaattaagcttaaaatgccagtaaatccccaccacaataccatttatatcaaaatggttatgagggactatcttttccccataactgaattgcgggggtgtctgaagctcccttatatttgattttttcacatgaatcatagttacaggagacatgataatcgccatctcacctgcttcgtctgctgtatactgtacgaccgtttgaaataatccaatatcatatgtatcaaaatcaagacatactccccacttatatggcggcatattatcatttccttccatctgccgatattgcccttttcaacctattttaccacatatacggacttcttgaaagaatgtagcttatgaaacaggaatacctcaagtattctgacatactgggagtaaagaaagcaggtgaagttcatggagtattccaaccgctacaaaattccaaagaaaatggcgcctcatatgagccatcgccccctgtcccagaatgcagcggatgtatgcaggaccgcaccggcatatgggtttccctatatgacccggtcaacttacccttgacagaaaagcataaggctctggaacatacgctccagggccttatttttcttatatcccttcaccaacgccttccaggacagacatcagtcttgcatatgaggcttcaccggccgccccataaagcatctgcaggtccccgtctctatgcagtccccagtctccacagtccatgacagccaccatattgtccggctcattgctatagagggtaatacgcatgccgcaaagccagtttgtcatttcaaaaggaaactttgtgagcttagactgaatcagccccagctcctcctctgtcagccagtaaaattcttccggattgtattcaaaggtaaagacaccctcataagccagcgcggcagacaggaactcactggtcgtgggcgcgcaaagggcccagtttttatcatcctccgtcacataaaccggagggtccggcagcatcaaatcctccctgcggattccggcctggcataccccctggttctcattcaacagaatcaagtaatccggttccctcagccattcccacttctggaaatgttccggcagcatccatgtgtcctggacacagtggaacgcctttgtccgcccagcggcacggtaataatcctccagcacccgtggaagggcgccgaacagctccttcagatatgcaatttcattctccgtatatccctccaatgtatccactgcgtaaagcggtttgaacatctcccaaaaagctgatatcataatatcctcctcattttctatccattgtcagctcctgtacgccaaaataagagccccctcttcccctcggttatgggctggatatcatacatggaaccttcatagcaggcccttgagccctccacgatggcaaaaggccaggcgttcgggcatccccccatgccagtccggcaaggccgactgttgcatccgtactctccgttcttttataggataaattatatcatatggcaggtttgtacggcaactggcagataggcggggaaaccgttgtggaatccgaatgtacatgctatacttttataagctgatagcgccatataaacaaatcgactgatgaggtagttatgaagtttatatttgatacgaaatattcagaaacagaattggaatttttgagtcgtcataattgtaaaatgatatccgaaataaaactatcaaaaatggatttatcagaacatgaaataccgcgccgaatgttcaaatacggtagtgagtatattggggaaatcctagatgatgagagtaataaacttgtatgggccgttttaagcaaatggaaaggtgtttattatttttcaacttactatgaggatttagatgcgttggaacaaggcttgtaatttccggtttgccgggaagctgaacaacacaaaaaaaccaataagacaggtaatggaatgaccgaacgtcagcagctaatcgcatataaacaggtcgtgcaggccgcaaataataaattgaaccaaatgctcggcattaaaacgttaggaattgttgagctgaaggaaaacaatgaatatttctttttctgcggcatatggtgcaggattaagctattggacttacggcttgccgtcccttccctattaatgcatgatggatataccaggggcttcctgctcgctgagacagatttgagccgcatgctggagaccggctctgattcccgggatgaatatcattacttgattgacatatgggactataatgaacataggtagctttttaaatcggaagctatgggagaatgacatgatgagcaatagagcaatattgattgataatattgataaaatacatactaccgaaatgggcgttgacagaatcagacggaatctgaaattagaaaacgttgacgtggttgaatattgtaaggacaaaattatggatgaaaattgccatatataccgacagggcaaaaattggtattgcgaaattgacagtgtaaagataaccgtcaacgtttatagttatacgattattactgcacacatcataaaataaatctccatttttcgtaaaaaatcgggaaacagatgcgattccgggacatctgcatttcccaatattttcctatagaaaggatacagccatgctggttacgatacaacaaacaaaatcaaatattgaaaatttatttgaagtttcctccaacggccaactcttgttccaggcaaaagccccgtggatgaaaatctccctgccgttcaatgcagaagacttacgggaactcaccttttccaatcctgccggggaaatagtttatactacccgctataaattcatcgacaacctcgtggaggagtcgattcccttcaaatacctgctgacaaaggggcagcgtttcgggcagtttgaaatcatcggcaggaatggcagtgaaggggccttctatgtcatgcagaacggcttgtttgacagcaaattctgcattgagtgttcagggaaggtctatctgggatacagccttgataagggaaggaacaattatgtgtccatttatgatggtgtaaagcagatagctcaaatcacaaaacctcttacagtcacagacaacctggatgtctatttctttcatataaaggacgagtatgcgtcaatcattccagtcctctccttcttcaccgtttattatgactatcggaaatacaatcacagtggggagcttaccaagaacacggttcagatatccaacagctatacctatggtaagaacaacgacaaatataacccaaactggattgccaaggagttcggccagcaggctgcggacgaattggaacagaaattaaggaaaataagagcacaaggttcggcccaggcaaagaaaatcgtgaaattagtgggcctggcttatctggttcttatcctgctggccattgtactgttcgtggtcttaaaaagtaccctgggatgatgagggcttttatcataatttaatggagaagtagagcaatgactatgaggatttagatgtgttggaacaaggcttgtaatttccagcttttgagaaaattgaaagattccggtatgaactggaattggctctgtgaccccaccggacgccctactccaaccgcttcggtcgtggctctcggcgggtgattttcttcctgctgggcgcagtactgattgcggtaagtatttgggcatttgttatggtgctgtaagttttgacaacatcgtaaaggaggatatatttatgtttgaagcattttacgagaaatatgccccagaggagcaggaagtggtcgctctaatccgcaactgcatcggtggtgggtataacaataaaggagatttttgggagatgactgccatatctttaggtatggtgttctgcgctaccggggaaaataatatccgggaggggcggctggaatggcccgtcaccgaggaggaacgaaacagtgaagagggctggggacgatttggaaaagaacagatttgccgtatcagagttaggaagctgttagatgaatatgtgccaaaccataccaccccggagaaattcaacagctgggctgtcaccggggtgttggaaccgtcggtatcctgcccggaactggaaacggtactggaagaatataacaagcctgtggtcattgaggacaaagtgctgggaacgctgaccttaaaccgggagttcgatatgtttgagactgatttctcatggaatggcaaggaggtttccctcatgcttgaggtcaacccggaaagcaaatcttcatggagccgtgcccgtactgcggcaaaaaagctggtttccgaacgggaggcatgggacaaagctatgcgtgaatttgcagcaaagaagctcacagagctggccaacgagtggatggcggaggatgaggaaaacaaggctgccgagccaatcacagaggagacatttgcgaagcgcattactctctcagaacttacgattacctccggcggcggcttcaccgcctattataacgatgacgccatgttctggggacatgccgtagaagttagcggctctttaaaaaaaggaattacctatactaaccttgcaggataacttatgaattcggataaggcgataacttccagtttatctagggagttagaatactggaaacaataaaacaccaggctgcccttcctttgcggagggtagcctggttttattatcccatctcctactggcaacggttctgccctaaagcagataaatagagatggcaacgtggacgaaatatccgtattatgatagaatgggattaatataagagttggtttctgatggttcaaaacggaaccaacattattgcgttggatacgcaccaacataaattggaatttggaggtgacacaattatgatagaattggatgcgttcaaaaaactgatggaggaaaatgatgaccgcctccctcttttgacacttaatgaattttttgaagggaatacagcagaggattccattgcaccaaacgaatgtggctttggacgtccttcgattgctgaaatttgggaactgatgcgaaatcttgagaaaagaccggatattgcctggatacgcattgaactgcacgatgacacagaaattgcagagtatgatgggaaagaggtattagttcttgcaggagaatcacctattatctgtacctctctcccagcgatggaattggagcgctttgcaagatgtgaatggctgcattctggtggggtggagaaatgggatatatcttcgatggactctttgttttcctgtaggcctcctgttccagagggcttttgttgttttgccattgtgtgggactaaataaaatattagaaaagaacttgttttgctgcaaaataccggtttgtcaaggaactgattaaaggaacaaatacacatagggacaatgtaaggggaaatttgtgacaacactcaatattgaacgggaattaggaaatttctgcaatgaaaattatcaccttttgtcagagtaccatgtgtatggaattgcagtaatgtattcagacaatgggcttatcgcctggattcgtagcaatggattttatgcggacattcatgccggggctaatgacgaggtccaactggaagcccttgctgaacatctgggcgctatggagtggaaataaagattaatgcttcatttatatcatcacccatgtttccaatctgttgtattattaaccagactcagtatcggaggtcaaggggaattatggaagaagatttcattgatgcatgtgatgtattgcaggaattgtgtggtttattaagcgggtacagatatgaactgcactatcatgataatggcgagtatgagtatttgaatgaaacaggcgtatgtattacaatcttcaatccctattcagaaaataaaatgtatattgatttagaggaagaattcacactttcatatggagcataccatgagcactattatcccaacagcactgactacaaagagatggtccaaactataaaggggatattggacaatgagctatgctccgcgaccatgtattctggtgagccattgaaatggcttggaagcactaccattaccaaggccgaaagcagagagcgccctataaaagatgtgttttcatttatattgaaaataaaagagtttaaaatcagattaaatactgatggtggagaaatatattataatttttggaatccatcagatgacaaagtcattaaaataacaaagaaagcataaccctatttttaagtcctgtatataagggcgttggacagaacgtaaaactgggatttaagagcagggattatagaatgagtaaatttctaacctgctgggctgacaaatgtaatgtgaggaagttccaatcatgctgatttaacgtaaatgcattcaggaaaccgattgctaaatggcccgcaatgttctaaaaaagaagttataatggagaaaatcaggaatggaacatttgaaatacataaaagggatggacagcgtaatccaggaaatacctgctcaataccggtatctccctctttttggtaatatccttaaacttgaatatttgaaagagtttgattatgaggaatggactgatatttataatataaggcttcttgttgctgacgaagctgaattatataaaattcaaatcttcatgaaaaatgttcatgggagcatttccttcaacgtatcagaagtattgtcaggattttcgatttgtgatatgcaggaggacggttatgaacaggacacccgttatcgtgtatatgattttgaaaacggcgatttttctatttattgtgaggacatagaggtggctttattaaaaaatcaaaagtaagctggtgatgggatgggaaaacagataaattattggatggattatgataactttttgctggtcgcgcaaatggcagttgacttgggctgtacggttgtaaaagaggaccttaagataggcaaagtcattgaaagcaaggatgccggtatcatcaccccctatggaacatccaattatccaggctactacttccatcttccggaggcaggagccatagaggtccttaccgtaaatggcaaggaatgtttggattatggctatactgcaaccgggaatgccctcattgaagccagctactcttccatcgtcaatgagcccacaggcgttgccgggtcacggcagaaaaaggaaatccacagggcaagaatctattgcatatccggatattacgatgaaaatgaaaagtatataccaaggccggactgtctgaccaaggtgtatcactccctggtgagatatgtgaaaaagatagctccttatacggaatttacagatatcctgataagcacgaaggacgaaaactacggggaggaatatgaatacagacataaggaatacataacaaaaaactgcctggatttgattaataacaaaggatacaaattatgttgaggatatcggttacacttttaacagcttgaattgcatgagaaatcggaagttgcaaaggagagaaatttatatggcaaagacagcatggatattttcatacaagattaaaaagaatgttacagatgaggagttcatcgaaaaaacaaagagcttacatgatgaagttatttctaaagcaaaagggtttatttcttgggaacattatgtgcaagaaaatacttggactgattttgtactatgggaaagtgaagaagatgcaaataatgctacaacggtagggcaaggtcataaagtgaccgaagacttctatgcatgtatacaaatgaatacttgtagagcattgatttcacatcttgtcaaaaaatattagtaacagacaaattccagtttgatgaggtatctgagtggaaaaaaatatattcttttttttcatattatgcatttgggccgttatttatttatgtttggctgtatacatatggttttcaaaaaaagcaattggtttctggggaaataagaaaatgtttgaggtaacggatataaaaaagtataatcataccatgtccaaactttatgttgcacatggcattgtatttattctgttcggacttcctttgcttacaggtcattccaaatggatatttttctcggttgcgggagttgtagtggaaactattgttttaatggcagtttattcgttggtgattaagaaaaaatacaaaaagtaattttgacaggtgtatcgtttgggatgaaacttaaaattataatcggattatatgcaggaatcctgttattcagcggttgtgcttcaaatacatctgttgtcgccggacaatctgcttcagtgaatgcagaatccgcaacaaaaggcattaacaaagaggaaccgaatgtaaatgacgcacatttagatgataccatttatatcggagaatatctggattctgatgtcaatgagcctaatcttgaaattgcgagaggtgatgataacaaatatatcgtacagataggaatttaccgcctgacttcattaagtgatggcattggggagttgacggctgatggtatgaactttactgcgaccgatgctgcagggagtccaatcaggggcatcattacagcagacggccaggcagcaaccgtcacttttacagattccacctgggattatctgcaaaacggttctgctttccagtacacgaaatcatctgatactccaaatatctggaatgaataggccgcttatcggtgattgggttaagtgattcaaaatggaatctatattttacgttagatgcgcgtcaacacacagcagaatataagagaatggagaattttaatatggggcagctaatgaatgatattgtcagtacagcggacgcttttacatctaattttagtgacaaagggccttttgattattccatagaaagtcttgtgttagttgacaatttgttagaagaattaagtgattacgaatgggatgaagataatctctatagtcttgaatctatggttggatgttatgtttttgaaacagccaggaggaactatggcggagaataccgttgggcagaaaaggaacaacaaccccttttgatagctggattgcccgatttctttgtatcaattcgcgcatgggaaaaggttaaaggccgcgtgatgaatggcaaggaagacaacattccattttatatcgccggatacaaagaacacatagaacgcggtaaaaataaaaaaggatacagcgtcacaatcgtataatggaaaagaatttttacaaaatgaactgtgaaaatcgtaatttatctgggggtgcttcatatgaaacgctatgaaatttacaagcatatcggtaatctatccccattaaataatgggtggataaaagaactaaatttgatttcgtgggacaataaagagcctgtttatgatatacgaacatggaatagcgaacatacagagtacggaaaaggggtaacaattacagcgggacagatggttgttttaaaaaatctgcttaatggaatgtcaatattctgatttccaccaggatgattcctacaattacatcgccaacagtacccagaaataaaacaggctgctctcctatcctaccgagggcggcctgtatttatttccccattctctaatgacaaaagaacttacttctgcagcaagaaggaaacatggacggattaggcggtatatgataatataaaagtaatattgaaaccagcgaggcaaataaatggacgagttccagtcaatggttgaagaaaccaaagcccttgtgcaaaaggaaataaaaaataaagacaatgtccctgactttattttggagaagcagctatatttaattttagaagaattggataaaatggagcgaatcagagacatccatctattccatccttattacccaaaggggattgcggatagctgggactattcaaatccattggcgatcagattactggaattattagaatcatatcgggagttacaataacgttgaggcagcttccggtttaccgggctgacaatcgaaagttgaggagatacgaagggaatgactgaacgccagaaactaattgcatataagcagaccgtacaggctgccaaaaacaaattaaaacaaatgagcggtatcagcatactggaaattttagagcagaatgaaaatccaggcttaaacgaaatgttttccgcctataccactacttttggaaatgatattgaaccatatagcaagttatcatacccatccccagcagagacgttttattcctggctcattggtactatggagttgaaggaaaacgatgagtattacttttactgcggcatatggtgcaggattaagctattggatttacggcttgcaatcccctccctgtggttacataatggaaataccaaaggctttctgctcgctgagacagattcaagccgtatgctggaggccggctttgattcccacgatgaaaattattacttgattgacatatggaattatagtgaacagcgaaattattaaatcggagtttgaagaaggtaaaacaatatgaaatataaagttaaaataactgtcattgataaaaaactttatcctgaattgcaacaacaatattgccatgaccctaattcgggtatctgtccttgctataatgtgggagatgaatttgtattttatcgtgatgatgaaagagatgatttctggcatatgggtttgaatacgttaattaagaccagtggtaatgcagatacagttgcaggcggacctaaaatgccattttgttccgaagcatgggacgctatttcacgttatatttataccggacttcaaggcggctctatcatgaaaggttggatgagagaagaaaacaccatgattacctgctgctcggacggaacaaggcctgtaattttcaaaattgagcgaattgactacgaataaaaatctgggactttcagtttatgcaaccggaacacagaccattaggaggaaaaatgattttatacagacctgttggctcaaaagaattggagctgataaagaaaagcaattatcgcagatttccaccgagattagcggaacagcctattttttatccagtcctgaacgaacagtacgcaacggagattgcttccagctggaatgtaaaatataatgaggaccacagaggttatgtcacaaagtttgaggtagacgaccaatattgcggacagtttgaagtccatcaggttgggggcccgcaccataaggagttatgggtcccagccgaaaaactggatgaatttaatgagcatatcatcggggaaatacatatcatcagcgaattttcagatagataatatgttatcttgtaaaaccgatgcggcctcggaagcaatgagagggctatcaggaatagagagtttaaccagaagggaggtccagagaatcattggaatacaaagtgaatgaccaggggcttaacgcttccgtatttatccctttcgtcaataaagtatggcctggagattatgatgaagagaaaacgcagacagcattatcaaaaacactgaacataagcgcttacgaaaataacgtacttgtaggctgcctgcggattctttcagacggctatttctttggcacaattacagaactgcttgttctccccgaatatcagaaacgtggtatcggcagcaagctcctccagcttgctaaggataatacgccaaccatgctgtattttggcgcacagccgggagttgaaccgttctatgaaaggaacggttgccaacggagcctgcaatcctacacaataaggggcacaaaatgaccaattacacatttgaagagataaaaggattgttattaaaaagcatccaggagcatgattttgaatcagaattacgcttatgctttcatgacaacccgaatgaatacatgattataatttatgatgaccactgctcttttcagcggtgcggcaatccaaaagaagcaagcggcgagtacaactacgaatcattggatgagctgtataaagcccaacaggttgatgggattgttttggaaagggactgggggaaaattaaagagttgcagtgtacggattttgacatattgggcctatgggactaatggagggatagccatatgacagcagaagaagtcttttgcgagttaagcgataaatatggtgatgattttaactggcatatgctgccactctcaaatcatacatttacagcggagctaaagaaagaaatcggcaatcgtcacttcctctatcataaacagatatgggcggtagccaaatgtgattcaaacgatgatgtattgtatctggctgatagtggcgaaggcacagacatatattatattttccatttaacttattctgaatgtaatgcggatggatttccccggtataaagagtttgaagggataaatgctgtaaaagaatatattgaacaatcaatatgacaaaccgaaattacagaaagcgggaagaaacaatgagcaaatataacgccctatgggaatatatacagaaaaacggaagcccctcattcaagcttacttttgaagaaatacaggaaattgcaggcatacccatagaccactctttcttgaattataaaaaggaactgacgggctacggctatcaggtcggcaagatttccatgaaggaacagacggttatcttcaacaaagtagattgataaacaagattccaaggaatggcaaaatgagattaatactgaaatatctgaaggggagatatttttatggcagtagttaatcaccacgatatgctgatataacttcacacttgaattctttatcacaaatcatccctcactgtcgaatatccggtggctgtgcaactccaacgcctccttgtgcaaatcaaagccataccttggataatgcatctcttccctgcaccacattccatccctcgactttgaggacatccgcttcatgtgacgggactggggtaagtgaatcagacgggtttgggaggcacaagaagcgttccttgcgcaaggaggtccagacgcaagtcggggacatcagggaggacctctggtatcagctggcggaacaggtcattgggctgcatggggaggcgaggctcttggaggtgctggaggtgtggatgcctgaaagcgaattgatttgccgtctatccataaaaacctcctttctgcaatttctgcaattaattcaaatcccattttcttaattaattgcaggatttgcggagtttgtcacctattaattgcgtaatttgccgaaaaatccttttttacatgcaaaaactgcaattaattctaatctcaaatgcaaaaactgcaattaattcacattagttgcagggtctatgttgttctgccatttaaaataggcacattctttcacaaaacagcacatatataacagacagcaacctcccgaccctctgcctcctgcttttgcatccagaatttttgccctgtggcactctcatagccctttcctctggcccccttcttcctcgcccctcccctcgccctccggccccaggcagccccaaccgccgccatagcctttgtttacaagggtttccagtcttttctctccccattcttttcccctttttcagcggcagaacggcccggtgccgggcaaaacggccgatggcccaggggaatgcctgaggcggggggcggcgggagatttcaggcacgaaaaaaaggacccaaagtatggttttcacataccttaggtcccttatttttccatttttgccttaaattgatgtcattttatgggccaatatgcctattttaggtggcacattaactacaaattacattcccatctgcttagctacctcagcagcaaagtcctcgctcttcttctccagaccttcgccggtctcgaaacgaatgaacttctttaccttgatggatgcgccgttagccttggctacagctgcaacatactgggaaacgctctgcttgccgtcttctgcctttacataaacctggtctaacagacaagtttctttcagctctttgttgatacggccctttaccatgccctcgatgatcttgtcgttggcatccggcttctcattcttagctgccgctgtaaggatttctgtctcttttgcgatataatcagcgcttacttcgtctctgctggtgaacattggctttaaggctgctgcctgcatagccacgttcttagccatatccttgatgtcatcgttaacaacatctgtctctacgtctaccaggacgccaatctttccgcctgcatggatataggatgcaacaaaaccatttgcctcctcaacctgctcaaaacgacggatattcatgttctcaccgataatggcaatctgggaagcaagtgcttcctttacggacaatgtctcgtccttagcccatctctcctccatgaatgcatctaaatccttagcggaagtggtaagcgcctgtgctgcaacatctgcaacatatgtctggaacttctcgttcttggcaacaaagtcagtctcagcgttaacctctacgattacagccttcttctcatcagcagctactgctgtagctacgatgccttctgctgcaatacgtccggccttcttggctgctccggcaagtcccttttctctcaggaactctactgccttctccatatcaccgtcagtagctgcaagagctttcttgcagtccatcattccggctccggtcatctctcttaactcttttaccattgctgcggttactgctgccatttcatcttcctccaattttaaagttttaattaagcctcaacagcctctgtctcgaaagcctgggcaggaatctcgatttccattgcgccctctaaaacttcgccctgctttgcttcgataacagcatcagccatcttggaaacaatcagcttaacggctctgatggcatcatcattgccaggaattacataatccagttcttccggatcacagttagtatcaacaataccgattaacggtataccaagtgtgtgagcttcctgtacgcagatgtgctccttcttcgggtcaacgatgaagattgcatctggcagtctcttcatatccttgattccgccaaggtttctctctaacttgtcccactccttcttcagggcgattacttccttcttaggaagaacatcgaatgttccgtcctgagacatggtctcgatttctttcagtctgtcaatacggctctggatggtcttgaagttggtcagcataccgcccagccatctctcgtttacaaagtacattccgcaacgctctgcctcagccttgatggcttcctgagcctgcttcttggtacctacgaacagaatggtgccgccgtcagcagcaatgtcagatacggccttgtaagcctcatctaccttgcctacggacttctgtaagtcaatgatatagataccgtttctctcggtatagatgtatggagccatcttagggttccatctccttgtctggtgaccgaaatgtacaccagcttccagtaactgcttcatagaaattacgctcatgttatttacctccatttggtttttagcctgctccgtcgcgtatgggagttcaggctcttccgcctgcttctgacacttcccggaagacctggcaaactgctacccaggcaccgtcccgcagaatccacagacgtgttttttgtcagcctttcaaatatatcacaaaatatggcagcttgcaagcacttttagtaagttttcctgcaaactgccatatatattaatctgactctatattacccggctatccgccaacagctttttaaccgtgccctttatctactttaaatttgagttggatgccttgattgtcttcagttcatcaaacaccacgtcattcagaaccttgatataggttcccttcatgcctgaggaccgggattcaatgacaccggcgctttcaaacttacggagcgcattgacaattacggatcgggtaatgcccacgcggtcggcaatcttgctggctaccagaatgccttcgtttccgtccagctcctcgaatatgtggataatagcctccagttcggagaaggataacgtgctgatggctgattttacaatctgcaccttccgggtctcctctgcattctcctcattgacagaacgcatcatctccaggcctaccacagtggttccgtattcactgagtatgatatcgtcaatatcatactgggaatccgacttgtaaatgaaaagggttccaagccgctctcccgctatatcaatgggagtgatgatggcctgatacttccttacattttcctcggcaaagccaagggtggcaagatttacgttctccttggtggacaaaacgcttaaaagacgttcgttcagcatcttatccacgtaacctccgacctggtcttcgataagttcctctatctcatctaccccagaacagatgctcacccccagaaccttgcccttcttgctgattaccaggatattggataacaatatctcgctcaaaactttacagatgtcattaaaaacaactttatgagaattattgttatgcaatagcttgttgatttttcttgttttgtccaacaattgaacactcatctccgaaagcctccttatccaaattgtatatcacccaaaaatactctactaataatagaattttaacacaatttttaagcaataacaagagttttttgaagttttcgattattttaagattttgatatttttcctttttgtttttacaaatttttctatttttcactcttatccatgcggtagccacaggtctctccggcacataaaagcttattccccttctctaccatataagaaccgcagaccgggcatttctgtgtggaaggcttctgccaggacataaagtcacagtcaggactggcctcgcatccatagtagagacgtcccttctttgtcttcctgcgcaccagctccttaccgcacttcggacatgggataccgattttttcaagatagggcttggtgttcttgcactccggaaatccggggcatgccagaaatttgccgtgaggaccatacttaatcaccatctggcgtccgcacagatcgcagaccacatccgatacctcatccgcaatctttacggattccagctccttctcagccgtcttaaccgcctcgtccaggtcaggatagaagttgctgacaacggtcttccaggccacagtaccgtctgccactttatccagcagagattccatgttggctgtaaagttagggtccacgatgcttgggaaggaattcttcatgatgcggtttaccacatcccccagctccgttacataaaggttcttgctctcctttaccacatatcttctggcaatgatcgtggttatggtgggagcataggtacttggacggcctatgccctgctcctccagcgcctttaccagggacgcctccgtgtagtgtgcaggaggctgggtgaaatgctggcttgggtccagctgttccagctttaggatggttcccttttccaggttgccaaggacctgatttttctcttcctcatcgtctgactccacgtaaacggacataaagccttcaaaatccagcttggaagccgatgtggtgaacaggtggctgcccgccccaatctttacagaagtggtctcatatacagccggcgccatacggctggctgtaaaccgcttccagattaactggtaaagccggaacaggtctctttgcagtgattcttttacaatggtaggagtcaatgttatgtcagtgggacggatggcttcatgggcatcctgtatcttaacgccttcttttttagcctggcttccctgagcaacatatttctcgccgtaatgctcctttacaaatgatctggccgctgtgtccgcctcgtctgcgattctggtggaatccgtacgcaggtaggtgataagacccagggttcccttgccttttacctctacgccttcatagagctgctgggccaggcgcatggttttttgtgtggaaaagttaagtaccttggaggcttcctgctgcagggtactggttgtaaacgggatgggcgccttctttacccgctcccctctctttacttcctccacctcgtatttacatccctctaactggctcagaatctgatccagttcctccttgttgcggataacagccttaccgcccttggagtccctgttcccataatactttgccaccaaaggcttcttgttccctttcaggagaagatctgcctccagattccagtattcctcagggataaatgcattgatttcgtcctcgcggtcgcaaatcatccgcagagcaacagactgcacacggcctgcgctcagtcccctcttgacctttgcccacaaaagcggactgatccggtaacccaccatacggtccagcattcttctggtctgctgggcatttaccaggttcatatcaagctccctaggggtcttgaaggaggcctttaccgcgtttttcgtaatttcattaaaactgatgcggtaaacatccttactcttaagttcatccagcttaagagccttcatcagatgccatgaaatggcctctccctcgcggtcagggtccgttgccagataaatcttgtctgccttcttcacttccttgcgcagcttggccagaacgtctccctttcctctgattgtaatgtacttgggctcatagtcatgttccgcatcaaatcccaactgactcttcggaagatccctgacatggcctcccgatgcatctacctcatagttggcgcccagaaacttcttgatggttttcacttttgctggtgactccacaattaccagataattcgccattgtaaaactccttactcgctgttcatttattttcacaaaatggagacacaccccggcggatgccggaggatatccaaaatcctgacacttatgtgattgttttcatgtagttctgacccgatgtcctcactgcaaatccttccaattccagctccagaagggcgctcatgcagcgtcctgctgaaagtcctgtctgcaccataatctgttccagatgtctgggttcggaatctaggcaactatacaccattttttcaatcttggcaagtcccttctggtctttttcacggttaatacactttttttcgtgaaaaatgcccatatagtccagcacatcctcagggctggtcaatatccctgcgccggactgtataagctcgttacaccccacactcaggtcatccgtaatccggcccggcagcgcaaatatctccttcccctgttccagacccaggctggctgttatgagggaaccgcttttctttcgggcctccattatcagaatcacgtccgaaaggccgcttatgatacggttgcgcatagggaagttcctggccatgggttcctcattcggtccgaactcggaaaggatgcctccctggaaaggaatcgcttcatacagatcataattgctcctgggataacagatgttcacgccgcatccaaggactccatacgtcctcccctttcctttcaatgcgccctcatgtccggccccatctatgcccagggccagaccgctgacaatctgtataccggctcttgccagctcctttcccataaatccggctgcctgtctaccgtactccgaacagttcctggcccctatgatggctgcggtgggacattcttcatccggcagctctcctttaacataaagtcccatgggatagtcataaatatgcagaagccgtttgggatattccctgtcaagaggtgttacaaaacggattcccttctcctgtaaacagttatactcccggaccatgccggaaaaccgttccttccaccggtcatacgtgcggcatttttcctcgctttgtaagattcccagtttctttaattccattccttctatataatacgcccgttcaaagcttcctgccatctcccatatacgccgtatggtaactgccccaaagcccggaatacgggtgagccagtacagatattctttttcatgtctttggactaaatccatctccgggccgaaaaccgcattccggctggattcctgctccccactgttccctatccccatatcttttcctccagtcccccgtatcccaatgcttctgccagatgttccttctttatatccctgctgtcctccaggtcggcaatggtcctggcaaccttcagcgccttgtggtaccttctggcactgaagcctcctgactcatatatccgttgggcaaagtccttcgcctcggctcccaggccgcaatgcagttctacctctttcatacccatgcggctgttaaaacgtatctttgagcccaaaaaacggcgttcctgacgttttctggcatgctccacccgtttccggatggacgcagagtcctcattttcaccctgggccggattcagttccccaaaggtaaccggagacgcctgggcgcagatatcaaaccgttccaatatgggcctggatatatgccccagatatcgtctgatctggttctccgagcaattacagcggttcctgtccggatagaatccgcatggacacaggttcatggctgctaccatcatgaaatctgccggaaattcataattaccagatacccttgtcaccgtaattttccgttcctccaaaggctgtctcaatatctccaccgcaaaagggctaaaatgaggcagctcatccaaaaaaagtactcctcccgaagccagagacagctcccctggcctgggaggaacacctcctcctgccagagccctggctgttatggtgtgatggggacttctgaacggtctctcagacagtaagggacggcctgccggcaggagtccgcagatactgtagattctggatatctctatgtcctcctcacgcgtcagtccgggcaggatagttggaattcttttggcaatcatagtcttaccggttccggcgctgccggtcaaaagcagtccgtgcatgccggctgccgccacctccgctgccctcctcaatatggcctggccgttgacctccctgtaatccaaaccatccttcttctgacggccgctctccggacggtaaagcggagcatggcacggttccatggaagccgtgcccttaagtatccctgccatatggcccagagattccacccccaccatatctaccccttccattaccaggccctccgccacattttctatcggcaggaaacatcttttgatacccttctccctggccatggctgccagggaaagcacaccgcttacaggtttcaccctgccgtccagccccagttctccaattaccatgctgtcctccagcgtatctgtccccaccacctgaaacgcgcccaatatggcaaccgcaatgggaaggtcataggcagtacctcccttgcgtatgcctgccggagacaggttgacagttatctttttagccgggagacgaaatcccgaattcttaagggctgtcctgacccgatcctgggactcccttacctctgaagccagctgtcctgatatggaaaatcccggaagcccgtcagacacatccgcctccaccgagaccaggacaccttccacagcccatattcctccgctgttgattcgcgtaaacatccatccgcccctttcaccttgctggtaactataatatacattcataaatcagtggaactttggtacgataccgtaccggatttaaatataagacaggataggaagaaccctatcctcttgaatgaaagatataattactatactaaagggaacataaaattacaaggggcaatctgaactgttttccataacatgtctcctggggaccctccggggactgctgcgcctcctgtcccatcctacttttgaaactctgtcatatagggccggaaacgcaggggcagatgggttctctggcataccgggttacggcgttccctgatggcaatggtatcgcagaacatacgccacatgtcctcgtaagtctcctcgtctgttctctccctgagccagcggccccatccccggtcgctgttctcctgttccggttcaaggggttggtttacaagaaaccaggagcgtccggcgggatggactgctgcccttttatggttctcatcataaatgacccagttttcctccggcagccggtctgcaaagtgaggtgccaaaagagtcatgatatcgttcttcggaccgatacgcgacaccagtatgcctcccggagtctctgaaaagcgcagaaactctgtcagcagatgattttcattgtaaacattccggcacaggccgaatatatcataacatgccggaagctgaagcatgtccagtaccgacgggccgtggcggaaggcctgtatcagaaacctgtatattttatccgcccgttcccggtcctggctcagggaggcggtgtataccttcctgtatatctcctgggagagcttggcgcatacggaacggataaccttctccgccttttccgggcagatctgtacatccctgtactctgcaaaaagctccagttcctcatattctccctttacggccagccggacattctcatggccggccgggtcagaccaggcatcgtatacgccgcagagaatcccctcaagccatggctcgcacatgtaaaccgtcatatggtgcacctcctcaatccttacaggcttcctgtcacagaagcataatggtcttcgcctgtcaccggcatcttaagatgcatgtcatcaaagagtgtgagctggcggaaactgtccctgttctcaatatcccaggctttgcgcctctcatctcccacaagacaggatgtaatataatcctggtccagcctggcgccttccatcatgcgccctttgcaggtgatgaaatatctggcccgtttcaggaccacccccattttctttaagtcctcgaaccggagtccgccctgctttctggcacttacaattctctgggccgactttactcccatgccgggaactctgagaagctccccgtaggaagccctgttgatttccaccggaaacagctccagatggcgcagggcccagtcgcacttgggatccagaaatacgttgaaattcggctgttcctccgacagcagctcctcagccttaaatccatagaaccggagcagccagtccgcctggtataacctgtgttcccttaacagaggcggtctggctgtcacggaaggcagacagctgtcgtcgttgaccggcacataggcggaataaaagaccctcttaaggccgtaattctcatacaatgcctgtgtaacagccatcatctggtaatcattctccggagtagcccccacaatcatctgggtactctggcccgcgggcacaaagggcgtcctggcataccgggagtcgggaaggtgccttctttctcccccgtccctctgcatggccttctgtccatcacccggatcatccggccccccgccggataaaccattgtttcccggcaaaagggcgcctggctgtgccagctccggacgaatcagggcagcgccgcctgcaaaaccagccctctccgttgcatagggcttcttaaattccctgtcatatcccaggagatggctggacaccgcaattccctgctgcacctgacgcatgggctttaatatcttatccctggtcttcccgggagccagattcttaagtccctcagccgtgggaagctccagattaatgctcatgcggtcagctaaaaaacccatccgctccaccagctcagagtcagcccccggtatggtcttcacatggatataaccgttaaaatgccactggttcctgagtttatgcagggtctcgtaaatcagctccatggtatgatttgcgttatacagaatgcctgagctcagaaacaggccctcaatgtaattcctgcggtaaaattcaatagtaagcttacacacctcatccggcgtaaaggcagtccgcaccacatcattggaacagcggttcacacaatatttgcaatcatagatacactggttggtaaacagaatcttgagaagggagatgcatctgccgtccgctgaaaaactgtggcagattccggcctctgaagtgtttcctatactgcctgcctttccctttctccttaccccgctggatgtacaggccacatcatacttggctgcatccgtaagtatctttaacttttcctgtacgcttaaattctcctgtatcaacatgatatcaccatccagaacatatgtttgttttgatagtataacacagaattcaggcaaacgcaatcgcaaaaagaacatttgttctttttgcttgccggcgaacttttagggatgctgttttcaatgattcaacacgttcaggctattattttaaggcccatattctctgactattattttcatacacccccatgtatgaaacctaattataaagaggcctgcgcccgtccccgccatatcatatgacgtgaatccggccgcaggcctcacagttatcagaaaaatcaatggagcataattctgtccgggatttggatttgtctctaatccctgtatccgttgggattcatggactgccatttccaggaatctgcacacatttcttcaatccccttctcagccacccagcccagctcacgctttgccttggcagaatcagaataacaggtggccacatcaccttcccggcggggctgaatctcatattttaacgtcttgccgcaggctttctcatatgcgtggagcacatccagcacactgtagcccactccggttcccaggttatagatgctgacgccctctttgtcctgcagcttctgcactgcctttacatggccctttgccaggtccaccacatggatgtaatccctgaccccggtaccgtccggcgtgtcatagtcatcgccaaatacattcagatggtccagtttgcccactgccacctgggcaatatagggaaccagattgttggggattcccttgggatcctctccaatcagaccgctctcatgggcgccgatggggttgaagtagcgcagcagcaccacgttccactccggatccgctgtatgtaagtctgtcagtatctgctccagcatgcccttggtccgtccgtaaggattggtaatctctcccttggggcagttttcagtgatggggatttctgccggatctccatacacggtagcggaagaactgaatacaatatttttgaccccatggctgcgcatttcatcgcagagaatcagggtgcctgtgatattgttgtgataatactccagaggcttgcgcacagattcccccactgccttaagacctgcaaaatggatgaccgaatcaatctcctccttgtcaaacacttccttaagggccggctggtccagaaggtctgcctcgtagaattttaccttcctgcctgttatcttctccactctctccagtgccttctcgctggaattataaaggttgtctacaacaaccacatcataacccgctgtcagcagttccacacaggtatggcttccgatatagccggcgccaccagtcactaaaatagccatggtatctcctccttacgaacaattgattgctgcaaaaaggcggaacaggttaagctgtctgaccgttccgcctgttatgactagtataaagggaaagctgtcataaaacaatgcacaattcttctatctttttacaatattttttgaatgacaccccttaaccgtgttttgcaaactctgtccgtatcttctcaattgcctttttctcaatccggctcacataagaacgggagatgcccagcttgccggcaatctcccgctgggtatgctccttcccgcggtacagcccgtatcgcatccccagaaccgtcttctctgtctctgtcagacaggactcaaaggcctcataaagctcctttacgtcctgttttaaaatcatggtatccagcgtctctttattgtccatctctatcacatccaccagactgacggtttccccgtccttgtctactccgatgggctcaaaaagggacacttccttggaatacttcctgctggctcgcagaagcatcagtatctcattttccacgcatctggctgcataggtggccagtcgtgagcctttatctacgttaaatgtattcactgccttaataaggcctatggttcccacggacagcaggtcctccatgtcgtaatcagagccctgatacttttttaccacatgggccaccagacgcatattatgctcaatcagcatatctctggcagactggtcgccctctttgcagcgttccagatactctttttcctctcctgctgataatggtttcggaaaagtcttcaaagaaagccaccctgcatattcttaatcttattctatgcgggggcagcttgccaagtgcttttacaagtttttattggcttatactattttccgaatctatgacaaacagctccttaaacttcttccggtccaggctgtggttgtacacaagtgcctcataatccagtaccgtgtcctgatagggacagcgctccgactctgccttggcccagtagtaataggttccctccctgtcatagcagcccagagggtggaccaccggaagttcctccctcatggcaagcagaaaccggttatagggtgtcatctcaagattggccctccacaggacctcagaagacaggtagacagcgccgagacgccccatattcccggagggcatgctgtaattcgtccatataataaatggggtctcgtaccacatgagatgttcctgcgccggaacttcagaactgggcatgccggctatgtcatcgtaaaattcatcctccacgctgggctggtgatccccgaacataacaatcatggtgggctggtctgtccggctgaaatactccaccagatactggaatgcctggtccgaacgcttcatgagggacaggtactggtccgtctttggatattttccctcatattggccggtaagccatacctcctgttcaaaattgtcgtaggtcccctcatatccgccgtggttctgcatggttacattgaagataaacagcttatcctcaggattttccttggcttccaccacctggatcagcttctggtaatccgcctcatcgcttatatagttgcgcagctcttcactgccctcgtaaaattcctggtccaggaacgcgtcaaatcccatattctgatagcactccacccggttccagttttctccgggataagggtgcattgccacgctgtaatacccctggtcctttaaggtgctgaccatggaataggtccccggctttacattgaactggtaggcaatggaattggcaggcagcagggccatggagtccccggtgagaaactcaaactctgtattgcttgtcatggaaccgaacacgggcacgcaaaggctgcccctgaccgtgttttcctcaaggctgtccataaaggggaaatattctgtattggtggtaaaatcacctgccgtcttaagctctgccaggctctcgttcataatacatattaaattgaccggcgttacaggctgcccgtcctccggcgggttttccgggttctcctccaggcggctatatatctcctttagcctggcgttactgtacccctgaggcggcttctttaccacatactgcagggagacagcggtggacagcacatagccgtattcctggtatgtcccgttgatggcccacatattgatgcccagcccccaggaaggtaccagaacggcaaagaaccatgccccataggccgctatggaggcagttatgccgcctcccaccgccaggcggagtttccaacctttaacccggcgcggtatgaaccacaggaacacgttcatgagcagaagcaggacaaaggctgctttcatctgacgggtgatgaaaaattcgtagttgccggatacggtcatggctgtcctgaatgccatcacatcccacagcatgatggggcggccgcggaaggccaccacaaaggtctccgccagggaaatgacatataggatgcaggaggcagcgggcacagcgattctggtcctccccgtgacagcaaacaaagccagatacagcacataaatccagcctatgttcaaagcagccatataataaggaaccgtgtccagattccccgtgacatactcaaacataaagtatgacgccactggggccattagcagacacacggttcccgctgtataccatatatattttataatctttatcttattttcttttgtcaccattgtcgcctttttgttagaattttgttaataaaatttaataaacttatcctaacataaaggatttaatgattcaagagtcaaatgcttccatgaatgacatttcacagacatttcacagaaccttcacatttttccagcccgcttctcagccggagggaaaaatcctctccccgtccaaacgctcttatccttaatattcattcatgatatatttgacctttggaacaattatatgggtctggacctgcgtaatgcgggttccttctatcagggaaacatttagtacgtaataggaatcctcatggtaaaacagccggaatgtgaatacctttccctggatttctttaaaccagatctggaccgggtggccccaggcctcctccgccgtttcatcatattccagtcctacgatgcccctgccggtaaactggtatatgcctgcatatatatggttgtagctcttttcttttgaaatatactcgtccttccggtcattattaaaatcaattttataaaaggtttcataaggtgaaacaactgagccgagccttaaaaactgattcagctcaatctccggatcttcatcacccgtatagacatcttcatcgtttgaacggtatgacaggtccgccaaatctgtttttatctcttccagataaccggtgacatcccctacgtaagcagcgcggttatcatatattttctgccacataaatgattcaggcaccgcctcaataacggcgtcttgtccgccttccggtatcaagcggtgtatcattatattgtccagataacggggacgctcaccccccggaaacggccgctccacaatatacagtccgccggaatgacagattatttttccgcccagatactcaggctgataggtgcttacataagccagaccgcccgcagtctctcggtaaatatgcagatctcctattttccctgtgacgctgtactgcagcaggagaaagtaatccgtagggccaagggaaattcggcagacatactgggtgccgccgttaagcgtacgcctggcctggctcagatatgttccatatttacgttcaaaatccccctggtctgtctggtacatttccattcccagcccgcgctccagacgatccaaagccttgtccgccagtaaaccggccagaatttccgtgaaatcatcgggtatgtccgcacaattattttcaatagcagcagaagaaccctgtacttttaacaaaaacacttctgccacatccggaaggttatagggaaacgcgctgtctctggacggatcctggtatgtaagcggtttatatatggagacatccgtgcccacaccaaactctgtcacacggatatcatccggctccaatacagccatgtaatccattaaaatcgtggtttggccatcctcctgtattctggcgtccaccagatacctctgcccggactgaatctcctggtacagtgtaaaagcagccgcctttccattgaaatgtttaaaccacatatcaaccagcctgtaatgattgtccttccatgcctccactgctgccggacactgcttaaaatccttatggtaccatttgatactgtgttcaaacggctgcctgtatcccggaggcgtttttgtaaatatctcatctttgccgtcattgtttatatccatgatatacatatggctccagtttatagcatcggcatcctccgcatcctccctataagccgtatcatcatacaaaaaaggccgctcctcgttccgatactcccattcatccccataaaatgtatttttcgccctgtttgcatagataacgtcatatatgacatcatcgagataatcctgaacaatatggatatcaggatgctgctcattgcggtacagaaggtgtggttcggaaatacggaaggtccggttgaagcatatgctgtctgtaatgttggccagatgaaagatagtccggtcaagcatgtatatctgcaaattgacggttcctgtggaatcatcaaaacagcttgccccataataaaaggcagactcatattgaaataatgtaaaaaacctgacatcgtccatatactggctgttgaaaaaaacatacccattctctccctcaaccatcatatggacataggagatggttcctcttccgtccttttcaaaggctatcagctcatcggtcccgtcgccgtccgtatcacagcggtaacatgaatattccgcctcattttcgttgaaatcagttatcgccattttatttgtcatttcatccgtcatgtctaacagagacaggaattcatggtttgcaatccgaaaatcctgttggttcattccatccagatattctatacaggcatccgcatcctcctggttcattctgtatttcaaatcgctgactaattccaccggaaaaccgtaacaatcatctgccggctccaaatcccccggcagcccggggaaacatgtattatcttcaaccagcattgacaagccgctgtctgtcagtgggagcacagacaattccggctgctctttcacaggctgtccggctgctgcatccggtccggctgctgtttcattcggtccgtcagccgccccaaaacaggcagtcagcaaaagagaaataatgcttacacttatgatcagtctataccccatggatacctcctggtattacctccgacgaatcctcagcacttccccgtcatatacgtatacggaatttccctgagacaatcctcctgtaaaatatcacggtcagcagagtcgccgcaatccatccaaagggccaggccatccagatacccgtgcttccgaaacgccctgtaaggatatttgccacgataatgcgcagaatcaaatccggcacagtggccagcacaaaataggtcatggctccggagccccggataatgccgtctgtcatgagcttaatggaaatcataaaatacatggggcttacgatgcgcagaaactccatgccggactctatggcccgggtgcttcccgcccccaggaacagtcccatcatctggcggctgaacacaaaatacagcagaaagaacgggattgtggcataaaaggacagcctgacgccggtcttaaaacccaggggtatcctctccctctttcccgctcccaggttctgggccgtatagctggacagacagcctcccagtgacatgaatgcgttgatggcaaaggtattaagcttaacggccccggaatagcctgctatgacagcggagccgtaccggttcacgatttcctggacaaacatatttcccactgacagcacgctctgctgcatgatgctgggcactgcaatggctgctatctgccccagcaaaacagcgctgaacagcacggtcctccggtcggttttaagggcgcccagacgtctggccagagtccccagagccaggatggcagaacccccctgagcaataaaagtagcccatgccactcccgccactcccaggcccagccaggccacaaaccagtaatccagcgcgatatttcccagggacgaaccgatgagaaaatacaggggcgtcctggaatcccccagggccgtaaatatgcctgtacatacattgtagagaaacaggaaggtcagcccgtagacgtagatcttaaggtacaactccccgtccgcgaatatgttgtccggggtatggattaaacgcatcatatccccgcagaaggcatatcccagcacggtcagaatcaggctcatggcgccgcaggcaatgaacgccgtgtagacagctgtcttcatcctgcctatgtcctttgccccaaagagcctggacaccaccacggaagcccccaggttgcttcccaccgcaaaggccatgaatatcaccgtgatgggataggaggcccccacggctgccagcgcatcctcacctgcaaaccggcccgcgatgctgctgtccgcgatattgtaaaactgctggaacatgacgcttataaacatgggcagcgcaaaccgccacagtgtctttttcggatgctccgccgtcaaatctgtaatcatgataccctctttcctcccaatgacaatttatgtaccattatacccttggtctgccataagggcaaccggaaatatagaggaaacgcaaatctgaaacgcaaagcacatatgaacggaccgcggagaaaagcactgacaaaatactgcaaatcagcgaaaaaaaacgcccggggctttcccttttacaggatttgccccaggcgcagtcttttcacatgataaatccattagtggtggaagagacggattcccgtaaatgccatcaccattccatactggttgcatgtctcgataacctggtcatcgcggacagaaccgccgggctgcgccacgtattttacgccgctcttgctggccctgtcaatattgtccccaaaggggaagaaggcgtcggatcccagggccacgtctgtcatggtgtccagccaggcccttttttcctcagcggtgaagacaggaggctttaccttgaaggtcttttcccatcttccgtcagccagcacgtccatgtaatcatctcccatatacacatcaatggcattgtccctgtcagccctcttgatgctgtccacaaaaggaaggttcattacctggggagcctggcgcagataccagttgtccgccttgctgcctgccagacgcgtacagtgcaccctggactgctgtcccgcgccgataccgatggcctgtccgccttttacatagcatacggagttggactgtgtatatttcagggtgataagagaaatcatcaggtcaatcttggcagaatccggaagctccctgttctccgtgacaatatcctccaaaaggtccctgttgatctccaggttgttatgtccctgctcaaaggtgatgccgaatacctgcttgcgctccagggcctcaggctcatagtccggatcaatctggatgacattgtaattaccgtttttcttggacttgaggatttccagggcttccggctcatatcccggagcgatgacaccgtcagacacctcgcgttttatgattctggccgtgtccgcgtcgcacacatcagacagagaaataaagtccccgaaggaggacatgcggtctgctccccttgcccttgcatatgcgctggctaacggtgagagttcacccatatcatccacccagtaaatcttcctcaatgtctcgtcaagaggcaggcccactgccgccccggcaggtgaaacatgcttaaaagatgcggcggccggaagccctgtggcagccctcagctcttttaccagctgccagccgtttaacgcgtccatgaaattgatgtagcccggtctgccgctcagtactgtgatgggaagctccctgtccccttccatgaagattctggaaggcttctggtttgggttgcagccgtatttaagtgccagttctttcataatcatacctctctccttatttatttttatttacgattcttgtctcatatgtgccggcggcaatatcaataaagcgcacgaacagggacaccttgttatcctcgttaaggctgttccagaccaaatccgtaaaggcgtcaatgtccccgcttatccccaccttcttaggctctccctcaaagctgggaagaggatttccgtcgtgcatgtaggtgtggataaaacgtccctcccccgatgccggcgactggtacgcataggtaaaacgcaggcaggaatccggatttccattatcgctctttaaaatggacatggcataattataattgccgttttcaatgtgcatgatgccggagatccgcggtgtgtaattaggcgcatccggctcgaattccctgcatcgtaaggactgctcaaaagtcatctggtggtccattccgtcgtagatagtgtcggtctggtccccgttggtcacaatggtcttgtttccaagaacccgcacaggggcatatataatcaggcttgggtcctccagcttggcggggtcaaatgcctgggtgcggattccttccccatcctccgcaaacacgcggttgcggctgttggcgcttctgcccatgataaaataggcggttactgcctttgttccgtcttctgatcgcccgatgacgattccccgtccgggataagcattgcttttcagctcctgttccagtgacatctgattcatactgattcctccattcggcttaataggtttctgaaacttaaaagagccggctcccggacacgcaaaaaaatatgcatgcccaggcggtcggctcaaaatagttcatggtactgcgtgctccctgtggttgctccactatccgccagtcacacgccctaccattaatatatatctttttttctaatattgcaacccttttttagaagttttactaatcaagggagtggacgaaaccagtctttcgcacctgtctgtttcccctattcattgcggatggctgccaggggactcagcttcatggcacgcatagccggcataaatccggcggccatgcccacaaagatggcaaagaccacggctgccacggaaagccagggcggtattctggacaggttgcctgtcagtccgttcatttcctccaggttaacaaaccggttgataaccaccgagataccgtaactgagcagaattcccacaatgcctcccatgaagccgataaagccggattcaatgaggaacatgttgcggatatttcccatatcacagcccagcaccttcataacgccgatttcctttgtcctctcataaatggacatcatcatggtgttggcaatgccgatggctgccacgaacagcgaaaccgctccgatgccgccgagaacagcctgtatcatgctggactgctgtttcgtgctctccatccagtccgcctggctgctgacctggaatcccatgtccgctatctgcttttgaacctccgggacatattccatatcgtccacaaatatctgtgccctgttataggtcagatagttaaggggctttccctttttgttggtgggctgtcccggtatcacggctccctttttaaacaccttgcgcagctgggctttcagtccgtcgatgtccgtatacacgttataggaataggaattccagtcatccggaccgccttccaccatgccggttgcattcatcatgtactttttcggcggtttcacaggagtctgtccgtcctctgacgagctgacggaaccatttctggtctggaaataagcgtccacatcgaaaataacaaagaggggcttattcataaagtccacatccggcatctcgcccgtgtcccaatatccccggcctgtcttggaattataaaaattctgctggaccgtgttgcccaccaccatgcccatctctccctgctccggcagcctgccttcccccaggggaatctgctccagaaacgactggcttacgcccataagggacagatactgggcctcgtaggctccctggcgcataaccacattaatttccaggacaggggataccccggacacatggggcaggcggccaaactgttctatgacatcgtctgtgatgtaggtgggatccgaggatttgctgctcccgccccctccaatcatcaccgcgttcccataggatgaaccggaatacacgttgatggtggtcaggcttccccaggaggaaatctgttccataaacatctggtccagtccgattcccagggataccatgaccacaatggacgccgtgccgatgataactcccagcacagtcagaaccgttctcagcttcctgcgtcttaagttgttaatgctcatgattacgagatcaggaaatctcatcgtccacatcctcttcccttgctgccttgcgtttcttcctgattcggatgacaaccgcagctgcaataccggcggctgccaccgcaccggcaatcaccaggaacttgtatttgccccagaaggatggggctgcctccgcctccatgctgcctgcatccatggccgctcccatatcatcccagttctgttccatctcctccataaccatgagggtcagttccttttccacgggttctgcgggaacaccgttttcatcctcgtaatcaatgcggatgcgtaccgttccctcatccagggtgggggccacacctgtcagcatggtatccacgttgcctgtttcacccggcttgatgtttcccacataggcgtccgtggtcttgatggagtccgcctcaaaggtgacggtcacgttgtaaaggatgacctttcccgtgttgttgatgccgaacatgacattggactcagatcccacggttaagctgtccggcataacgtcaatggtgctggtgcttaaccgggcatactgctttacagggatgtccactacaatgctttcctctgcgttcttgaattcagggctgtcgtacttctccttcaccgtgatggcataggagcgctggtccactcctgccctggctgtaaacctggccctgacctcggtggtctgtccgggagccatattgtccaccaccagggaggaggtgcctgactccgtggtaaacacggcgctgtccgataccttctccgactccaggttaaagagaatgttgctggcaggaaccgaggtggatgcattcttcatgttaagaatcagctcaaactcgtcccctgcatagatttcctccggcaccgtgtggtagctctccacaatcaatctggccctggtcctgtcgttggcgttaaaatcccccagatcgtcctctttatccttggacgtgatatgtacgtaaaaagttccctcctccgtgtgcagatccccctcagagcttaagcggaaggtgatggtgtatttgattggataataacctgtataggaatccttgcggattgccatgctgtagggagcggacacggtttctcccggctgtacgcgctcaaaggtgcgatcatagttgccgtcgttgatttcaaagggaaacttggcatcgtcctctgaaagctgcatgctgaccgtcacatcctgggccgtggtctccctcttattacggaaatttacggtgtaatccatgacattgggataaacgcccctgggagtgggctggttctctcccaccacaaagtaattgccttcctttttgtcctcctcctcgtctgctcctgatgtggaagaggtggaaatccatacattaatatagtctgtgtcagaaccgccgtcccattcaagcagtacagggatgctgtagtatccctgaagggcatcgcgccgcaccctggctgacagggacacgctctttacattgcccttcttgatggttcccacgttcttggccacaaaggtggtctccataatttcaaagggatagtagtcaacggagtaatccccgtttccccgctcctctatctgctggaactcattggtttccaggagactgatgcgcaggttctccatatcctcatccgtggccctgatacggaagggaatggacatggattttcctatggtccctttgggtgattttgtagtaaaaacataatcattttcactggcattggtgttgtagcccagtttataatcgctggccgccgcgctggacggatacatcccggccagcattgaggctgccaggaatgctgtcaggcccctgcaccatttatttgctctcattctcattgcactccttttcctctgcattcccctcatataacgcttccctgccgcctgtctcgattcccacaatcctgccgtccatgattcggattctccggtccgcataggaggccagattgttgtcatgggtaaccatgaccagagtctggtcctgctccctgacaatcttctgcatcaggcgcagcacctccatggtggtcttggaatccaggtttcccgtgggctcatcggcaaatataatctgaggattgaccaccagggccctggcaattcccacacgctgctgctgtccgccggacatctggttgggcatatgcctggcctgccctcccacgcctaccaggtccatgtatttcctggcttccttaagcctctgcctcctggaaacaccccgaaaggaaaggggcagggctacattctccagggcattcatggtgtttaacaggttgtatgcctggaagatgaatcccaccttttcgcggcggaagctcaccagctggcgctccgtcatcttctctatatggactctgccaatctcaatctctcccctggtaggcttctccaacccggccagcatgttgagaagggtggatttgccggaaccggaggctcctacaatggcaacaaattctcccttatatatatcaaaatccagcccgtccagggcccggaccttgatatcgcctacccggtatatcttatataaattctttacccgtatgaccacgggcctggtttcttttactgtagggaccgacgacacggccagttgttcctctgccaaatccagcctcctttccagggcgtaaaagcgctccaatccagataacagcccgtatagacagactgtactgattttgttcagtatagcacagagaacgcgatttgttcttctgtttttctttaatcttcctttaataattccttacaccctatccgttttcagtagcaaatgtaacacgaaaacaggtaattgtaaagcagatcaggccagagcacagcaaaagaccggacttcgctgatgttcagcgggggcccggtcttggggggttattaaattttcacagtatggctcaggagtaccgttcataggacagcagatagccgtttttcttcagccatttcatatccagcctgaaaggaagtccgggaatgtccggcaggtaaaattttccgtccctgcgctgcacggtcacttccatgcagtccagtaccggctggttgcatacctccaggaattcctccatggcctcatcccctgccgtggcaatgagcggacaggcaagaaggggcaggccgcccgaagaaaaacgtatgccgctgcggaccgccatatcccgcacctgcatccactcccatactcctgcaaaggaggatgggaccggctggaaatggcggacgcctgcatccaggtaaggcgtgaacatatagtggttgcgcaccgactcgccggcagccacgggaacgggacagctctctgtcaattctccatagcctcgaaaatcaaatccgtgaatcggttcctcaaaccatgcgatattatatttctgtaccttatccgcaaatctgagggcctcccggaccgtaaatgaatggtttccgtcaatggccagctctgcatccggtccaatggtctctctcaccagcctgacacgctccacatcgcaatccagctttgtggcaaaatccgtacccaccttcatcttcacagtcttatgcccgcagtccataaaatgttccatttccccggccagatccgctccgcttaagtgtgtgctccctccgcttccatatacggtgacgctgtcctttaaagctcccaggaaccggtggaagggcatatctgcacgttttgccaggatatcggtgagaaggtactcaagctttcccacctcccctgccgtctctccgtcaaagccggaattacggcatgaccagtataccttgtgcatccactgtccaaaactctttttctccccggtcatgataaggggcagaatggtcctttccatgatggacgagcagggacacacgcccttgatgccgtcctccgtatagagctccacatatttgcttatcttggaatgggtaaacggaccaccggttgcgtcgtaaaacggctctttctggggtaccggcgcaagattgatgatgaatgcatctgtgaatttaagtaattcgccatcgtgcttcattttcgtctattcccatccttttggaagatatttaagcgtattttttatcatgtcatccaccagaagcctgatatcctcttcccggcagttatttccctttacaagaggatcgttcataaatgcttttaccaccttttccttatccggcttaagagctgcttccataatcagctcatggttttccagatggggcatcagaagttcctttaccttttccggcacagctcccgccaccaccggatagatatggtccttttcaaaaaccgcgttggtctccaccagcgcgcctgcgggcaggttggttatctggcaggccgtattagggatatttacattgctgacgacccttgtaaggccgcagagcgctttgattaaaaggattccctcttcgccggtaggttccagtttgacttcttcctgtccggaagccagcctgcggctcctgtccagtctctccttcaggtcattctttctccactgtaccgtggtcagaccgaatttccaggatgcaactgtctccgggtcattcaggtactcatttccgggcatgaattcagccagatgcctgtcccctgctgccgcaatcaggccatatcgcttaaacagatccatcttgacccggttggcacacttaaaggaggaattcatccagttttcaccttccacttcatatccctggtcaaaatgtgcgtcaatatagtcccggtaaacagggaacaggtcaatccccttataagaagcacttgaaaaccatgtaaaatgattgatacccagcacattaacatggatgtcatgccagtcaatatcctgttccccgcagctctcctcacagattcccttaaggaccttctgagttccaaagacctcatggcagcacccgaatgccttgatttccggaaatacatgatacagggtctttacgcacagcgacatggggttggtataattaatgacccatgccttcggcgcatattcttttatggccccggcaatctccacaaacatgggtatggtgcgcagggcgcggaccattccgccaggccctgccgtatcgcctacagactggtagattcccaggcgctccggaaggtgaacatcagactccatctcgtcaaaggtgccgggcaggatggaaatgacaacgaaatcgcagcctgtcagggcgtccttaagactggcgctggtctcaaacttccagtctcctttggcgtcgtcccgctgcataagccggctgccgattacctcattgttctttgccgcgtcaccatcaatatcatacagacgtatggtaccactgatctggtcttccagggcaaggtctgtcataaaggtccaggcccatcccctggaaccgccgcctatatatgcaatctgaatatccttaactttattatcactatacttcatagcttcctccttaatatgtttacttgaaatatacatgctctgcattcctgtacataatttgttccttttcttcccgggaaaatgcatcgctgcatgtgatgtactgaataaagtgctggtagctgtcctctttcagcaccgagggtatatccgttccgaaaatgagtctgtccgcccctgctatctcaattccatgcctcagatacctcaccgcattgggataggggtaggcatcagggccgcagttatggggcagggcagccaaatcaaaccacacattgggcagggccagcttctttaatccttccacaagcttatcctcgtccctcatggacacggccagcagatggcagaccacaaacttcatgccgggatgctcttttatcacattcaaaagccgttccgtctgccagctctcactgccgcatttgcctatatcaatgacaaacaccagaccatgctcatccgcataatcatattcagccttcatgatatccccgtccaggggcagcgtaaagtggttggccatgagcccggagccggtacttacctcaaacttcacaattggaaaacccagctcttcaaacaggtgttttcgtatctgttccttgcccctgcaaaaagggtcgtaggaagccgcggcacaaaaccggtccggatattttttcactgcctccatggaatagagattttggaaaccaaagtaatttccctggagcagcactgctttctccactccgttttcatccattttcctgagaatatccccggcagtcaccactccctggctgaactcatccggaagcatccggaaacgctcccctgatgcatattccgccatgccgtttccggcaaagcgcagctctcctcctgcccctgttcccgcgatacactgtaccagatggacatgtccgtctattatcttcatttcatgttccattttcatcatcctttcaggccggaggtgctgatgccctcaaccagatatttctggaaaaacaggaatataaggatggacggcagtatggacaaggttgccatggcgaacatggctccgtaatccgatgacgagcccgggtcgcaaaaaagcttaagcgcaaggctgacagggtacatgctggacttgctgacatacagcagggctgagaggaaatcatcccatctccacatgaaggagaatatgcaggccgtgaccagtgccggctttataagaggcagcatgatgcgggtaaaaatacctgcataggaacatccgtcaatcttggccgcttcatccaattccgtaggaataccgctgataaagttggaaatcaggtacacaaaaaatccctgtatggcaaagaaatatggaaccgtcaacggcatataggagcccacccagcccagcttctgataccacagatactgggggatcatgagtacctgggcgggaagcatcatggagagcagcatggcagcaaacaggatgctcttgcccctgaatttgaatctggcaaatccgtaggccaccagggcggaggaggccacggttcccagggtggccaccactgagatgaagatggagtttttgaagaaaatggcaaaggaaatctttccaaagcccttccatcccgtggaataattgctgactataaatttctccggtatcaggctgcccgctgtggagaatatggtactgttctccttaaaagaactcatgaccatccatataaggggataaatcatgataatgccgatgacgaaaacaatgatatggtatactgcttttttaaccactcgcttctctttcatgattaaagccctccttcatatacccagaaccgtttcgttgcaaacaggaacagggttatcagaccaatcacagccagcatgacccatgcaagggccgcaccatatcctgtgttgtagaattcaaaggactgcttatacatgtaaacagtatagagcagggttgaattcatgggttttccctgggtgatgatatagcactgggtaaaggccagaaagccgttaatcatctgcatgaccaggttgaaaaatatggtgggggtcagcaggggcagggtaatcttaaagaattttgccggtgcgctggcgccgtccacctccgccgcctcgtacagggactgcggaacctgttttaaggatgagaggaagataagcatggatgaaccaaactgccagaccaccagcaatatgaggacccatatagctgttctggtatcccccagccacgaaaagctggtctggattcccaccattcccagaagcttattcaccacgccgtccatggcaaacatcctcttccataagatggatactgccacggaacctccgataatggagggaaggtaataggctgccctgtagaaaccggacattttggaattttccagcaagagcatggccacaatcaaagcaaacagaagtttgagcggaacagacacaaatgcaaagaaaaaagttaccttcagtgttttaaaaaacgtttcatcctggaacatggaaataaaattcttaagtcctgtaaaaacaggtggtgaaagaatgtcataatcacagaacgaataatacaatgaaattcccattggaacaatcatgaacagcaggaatccaatggtaaatggcagtgtaaacaggacaccggccacactttccttgctgagctgctgctttaatgccttcatagcctctcctcctcgccttatgaaaagagcgacctacaacagccgctcttttttaatttgctaatttttcttggactccataatctttgagccttctgtaaacagctgctggccggcatcctcagccggcatctggccgtaacatacctgttcctccagcttgttcagaagatcgtttacctcgcttgagccgtcggcagcaggcgggttgatctgggaagaattgtcagatacaacttcgttgataaacttaatcacttcctggctggtctcatccatcttaggcgcaatggaatctgccactgttgatgacagaggaatgcctctctctcccagaaggatttcattacattccactgagtttgtgatgaaattcaggacctttgccgcctcgtccggatttgtgctgtcctttgtgatggcgaaaaactggcttggcttcagataatcggacttgacagggtctgctgaaggccaggtggttatggcaatctccacaccctcaggtgcggcgcttctgatggctgtgagctggttggtatagttaaacgcacaccatgacatggtttcaggattggaaccatacaccattgggtcctgctccacggatccgatggtcctctctgcgaagatagaaggatccacaacccatccgtcccttataccatcctcatagagcttgaaataggatacataatcctctgctgttccgcccagttttccgtcctcgaacatgactacatcattggcgcgcaggaaatactcaatgaaattctcaccattgttatatgcaatgttggtcttatatcctgtcttttccctgatttccttgcagagtgcaatgaactcgtccatggtcatattgtcttttaccgtgattcctgcctcatccagggccgtcttgttgtacagcagcgcaggtgcattgatgccgttgcagattgcataaagtccgtcccctaccttaccggagttcagtacatcttcattacagtctgccacgtcgatggttccgttttcaatataaggcgtcaagtccaccagcaaatcattgtttacatactgctggatatacttgtaatccatctgaacgatatccggcatggaatgaccggcagcggccgtagccagcttgttccagtaatctgcccactctgaaaactgtccgtcaaaggtaactccgggattctgttgggaatacagctctaagatagcctgtgtacgctcatttctcacctgattgccccaccaggcaaccaccatctccgaaccatccccggatgcagccttttccccggatgctccttctgcctgtgaaccggccgcctttgtatctgcggtaccggaaccgccgcatgctgtcagacttgccgccgccagggcagctgtaagcacaagtgctaatttctttttcatgattgaaaacctccctcgttctttagttgcttttgatgaattgattatacctgctttttcttgtcaaaccaatcaataaaaccgatgtccatggttaattttccgactttttcatacagtttatgcggatgcaacttttccttgtcctgttgaaagatatggtatatattaatctaagacaggaaatttccactgaaaacaggagaaacttatgagatacctgaaacggataaaacatgattttgaaaatctctccatgaaaaacaaactgctggccgttgtattgtctaatgtggtgctgattcttctcatagcgctcatagggctgcgcatttcttccaatgcatataatgaacagctctacaaggccattgccggaaatctgtccttttcctcccagaccatttccagcaacttaaaaagcattgagaccctctcctccgtcatcatctcctcctctgtgattcaggattccctaaaccgcattgacagtacggatgatcccattatatggtccgaaaacaacccgcggatcagcgcagccatcaacaattaccagcaggcctacaaaaataacggtgtatccgctattgcgctgaataaccgtcatttccaaaacctgactaatttcgtggtcatcaacaatgcggatacggacacggtacagagcgcagtggacaaggccagggagcgggaaggagccattacctggaccattgactatgaccacagtctgtatatactcagcagaagcgtcaggaaggtctacaacctggagctggaccatctgggcgacctgctggtttttgtggatttggaccggattgtaagggatgccaaccgtgcagtaactacctacggtgaatccagctatattctttttgacggggaccagcttatatacacctctgccgggattgacccggaaaccgccaacggattcatgaaacagacgggccagccctacagcatcatacaccagaacggacacagctattttgcagttaagaacaccattccctactacaactggacctacatcaacctggtcccctatgaccagattgcccaatccacagacatggcctaccgccttatcctggccatgctcattgtgggctttatcgctgccctggcattttccaggcgcctgacccgctacattttaaaggactttgaccttctaatacagaagatggagtttttcagcagcacggagcttaaaatgcccgaggtagaggtggactacagtaaaaggacggatgaaatcagcaggctgcaccagcatttcgatactatggccggccgtatccagtacctggtccagaacaattatgtgaatcagattttaagccgcgacgcaaagcttaaggcgctggaatcccaaattaacccgcattttttatacaataccctggaaaccataaactggcgggccaaagcattaaaggaccagcagatttcctccatggtggaatcccttggaaccctgcttcgcgctaccctcagcaacaaaaagccgcttgtttccctggattatgagatcggcctggccggaagctacatgaccattcagaaaatacgctttgaggaccggcttcttttccatgtggagtgtcccgaagaactgggcaaagctcttatcctgcccctcactatccagccccttctggaaaatgccatacgctacggtatggaggagatgatggatacctgcgaaatcagcatacggaccagaaaggaaggcacgctgctgattgtggaggtgtcaaatgaaggctctgtatttgaggacagccttcttgaaaagcttcaggacggtaccaagaatgcccacggctttggcatcggcctggtcaatatccaccagcgcatccagatgctttttggggaatcctacggactgtcctttaagaaccaggatgaaaaagccattgcaatcatcactataccatacaaaacagaggaagatgactatgcttaaattaatcattgcggacgatgaacgcattatccgcgaaaccatatccaccatcatcaattggaaggaatacgacatcgaggtggtcggcctgtgcaaaaacggaatggaaacatatgacatgataatggacgagacaccggatatcgtgctgactgacatacggatgcctggtatggacgggctggaactgatccgcaggatttccggcacagacctgaatgtacagttcatcatcctctcaggctacggggaatttgaatatgccaaggaggccatgaaaaacggggttaaatactaccttctcaagccctgtaatgaactgcagatcattgactgtattgagcagtgcaagaaggactgctaccagcagaaaatcatggaacggattgtgtccgaccgcttcatggcaatcaacagcatgaaccacaacgttattttcagcatcatcaatgacagcatatgccagaaccggggctttccggacatcatccgttcctatgagtcctatatcgactttaaattcacggtctacaggctgtactatgtgtattttctgccctttgaacacctggaggagtttctggatgatttgagactgtactgcagcgaaaatatttcctctgtcatcatacacggcgtctacgtcaataacaccctgcttctgttctttaaagactttgccgcaaactaccaggacctggagcgttttatctgccaaaggcactatccgggccaggccgtgaccctggaaaccgaatccaccctgtactccaatctggagcagcttctggtggtggttctcaaaaaaatcaggcgttttggtatgatttattatatcaataattttcatctgctctacacctgcaattacaacacccacatcaatgaattggagcagctgtgccagtccatcctgaaccggcagccggattccatgcagaagctgaccgatctcataaaggatataaatgatattacctttttaaagcagattgccagcaacctgttcatgaagctcaccctgaacagtccttccctctcttccacctggctgaccgaactcctggtccggatagaaaatgaacagagcataacggacttaaaaaaccttgccattgaacgggtggaggacatcctgagagagcctgacagcgggcaggccgtcagcaccatgacacagcagatatttgactatgtaagccagaacctgcaggatgacaacctgacccttaaattcattgccaaaaactatctcttcatgaatgtggactatgtcagcaaaaaattcctgaaggaaacaggcaccaaattctccacctacctggcggacatgcggattaaaaccgccaagcagctgctggcctcaaagggtctggacaagatacaggacgtggcccaggaggtgggacttggaaacaacccccagtatttctcccagctgttcaagaaaaaaacaggtatgactcccagcgcatacattgcccaggtcctgggaagacccggcaaataaaaagcaatcacttttttggcaacaatataaactgctgccattttttttaaaagcctgtaatttttacttgacttataacgcattctatgtaagaatatgacgaggcacaaatcagtgccatatctggctggtccggctatcgcactggtagagtgtgaactatttcccaaattcaatattttacaatataatgcgcaaaggagactcccatgagacatttattgaatcccttagacttctctgtggaagaaattgatgaccttctggcccttgcaagggacattgaacagaatcttccaggatacgcccatgtatgtgacggcaagaaactggccacccttttctatgagccaagtacacggacacgtttaagctttgaggctgccatgctgaacctgggcggcaatgtattaggtttttcatccgccaattccagttctgccgcaaaaggcgaaagcgtggccgataccatccgcatgatttcctgttatgctgacatctgcgccatgaggcatccaaaggaaggcgctgcatttgtagctgcccagaaggcccagattccagttatcaacgcaggggacggaggccatcagcatcccacccagaccttgaccgaccttatgaccatccgttccatgaagggacgtctggacaacctgaccgtgggcttctgcggagacctgaaattcggccgtaccgtacattccttaatcaatgccatggtccgctaccccaatgtcaaattcatactgatatccccgcctgagctgcgcatcccggacaacatccgcgacgacgtgctcattgcaaataacgttccctttgaggaggtgggcaacctggacgacgctctgggccagttagacattctctacatgacgcgtgtgcagaaggaacgcttcttcaacgaggaagattacatccgtttgaaagactgctatattttggataaaaagaaaatgaaacttgccaaggaagacatgtatgtgctccatccgcttcccagggtaaatgaaatctccgtggaagtggatgacgacccaagggctgcctacttcaagcaggcacagtacggcgtatatgtgcgtatggcattgatcatgagattactggaggtgcagaaaccatgttaaatatcagcggattacaagaaggcattgtcctggaccacattgaggcgggaaaaagcctggacatctactatcacctgggtctggacaagctggaatgccaggtagccatcatcaaaaacgcccgcagcaataagatgggacgcaaggacatcattaaaatcgaaggcggcctggatacggttgacttaaaggtattgggctacattgaccacaacatcacagtgaacattatccgcggcgacaggattgctgaaaagcgcgccttaaagcttcccaagaaaatcaccaatgtgattcagtgcaagaacccccgctgcatcacatccattgagcaggagcttcctcatatcttctacctggcagatgagaaggcagaggtttaccgctgccagtactgcgaagagaagtacagcgaatttaaataggatgattatgggacgctgcccgtaaatacatgaaaaggcagcccggtatcaaaatcccaaaggattgataccgggctgccattattatattatccatatccaatcccgacgcatgtaccgtatccttccataccgcgccctacagatacatttccctgtctgtttccttttttcctcccgggcctatgtagacagattcatcaaaggccagaattaacaggaatatgggggtaaggaaaataagccccagcgcataccctaccccatgtccaaaggaataggacatcttaacggatatcagaatatgcataaccgaaacgccgaaataagccagttgggccgccatggcgccgggaccggacacaaaccgcaaggacgcggcaatcaatgccatgatgagccacaggacaaacatcctgttattccagaaaagcttatactctatataggtgccgtaaaacggtatcagggctttccatcctgcttcccctgcctttctgaatatcatccagtaagccaggatgtagaggacaagcaccaccgcaattacaaacataaaaatcagcgacatccccatgagcagtatactcagttctttcaaaaaagcacccgcctttccaactatattccctacttatcggcaggcacgatttccagccagtagccgtccgggtccttgataaaataaatgcccatgcccggattctcgtagcagatgcagcccatctcctcatggtgcttgtgggtgccgtcaaaatcatccacatggaaggccaggtggaattcgcactctcccaggtcatatgcttccttcctgtcccgcagccaggttaactccagggtaaaatccgtcactccgtctcccaggtacaccagcttaaaggagccgtccgaagcgttcttctccctcaccggttccagattcagggcctctttataaaaagcaaggctcttctccaaatccagcacattaaaattgaaatggttaaatgtaatcataggtctctcccttctctctttttaaaaccggcctgcaccgcaggatgcagaccggcaattgtttcacatgtttcattgtttcacacgtttgcttcgcatgtttagttcttgggaaccatcatttccatgccgcccatgtaaggacgcagcacttccggtatcttcacactgccgtctgcctgaagattgttctccaggaaggcgatcagcatacggggaggagccaccacggtattgttcagggtgtgggccagatacttgcctccgtcctctccctgcacgcggattctcagacggcgtgcctgggcatctcccagattggaacagcttcccacctcaaaatacttcttctgccttggggaccatgcctccacgtccacagacttcaccttaaggtcagccagatcaccggagcagcactccagcgtgcggacaggaacatctaaggagcggaacagatccacggtgttctgccacagcttctcataccacatagggctttcctcgggcctgcagactacaatcatctcctgcttctcaaactgatgaatacggtaaacgcctctctcctcgattccgtgggcgcctttctccttgcggaagcagggggaatagctggtcagggtcaggggaagctgctgctccggcgtgatggtgtcgataaatttaccaatcatggagtgctcgctggtaccaatcaggtacaggtcctctccttcaatcttatacatcatggcatccatctcagcaaagctcatgacgcctgtaaccacattgctgcggatcataaagggaggtacacagtaggtaaatccgcggttaatcatgaaatcccttgcataggaaatcactgcggaatgaagcctggcaatatcgcccatcaggtaatagaagccgtttcctgccactcttctggctgcgtcaaggtcgataccgttaaaccgctccatgatgtctgtgtggtaaggaatctcaaaatccggtaccacgggatcgccaaaacgctccacttccacattttcactgtcatccttgccgatgggcacggttgggtcaatgatgttgggaatggtcatcatgattttggtaatcttctcagaaagctgtccttccttttcctccagctctgccagacgtgcggaattggcgctgacctcctgcttcacggcctctgcctcatccttttttccctggcccatcagcatgccaatctgcttggacagcttgttgcggctggcccttaaatcatcggcttccttttgcgtcgcccttgcctctgtgtccagtgaaatcacttcgtccaccagcggcagcttgctgtcctggaatttattcttaatgttctgctttacaatgtccgggttctctcttacgaatcttaaatctaacatggtattcctcctggatttccttgatataataccttccaattctggacaggtattcctgtactgttaaagagtatataacattttaccaggaaataaaagccctttttctgtttttcctgctgctgtattcctgctgctgctttcttacttctgctttcctacttctgctttccttccgtctctatgctgtaccggcatacgccgtccacataagtggcttccaccggaatgcgggccagctcctcaggagaggtctcaaagggattggctcccagtatcacaaaatctgccagcatccccggcgcaatcctccccttcacattttcctcaaaggatgcataggctccctccgcggtaaaggaatccagggcctgttttatgtccagggcctgttccggaaggtaggggcccacgtgatccttcaccgttgtcctggtgactgcgcactgtattcccttcatcacatccggcagctccaccgggcagtcggagccgttggaagcatgggtagtctcataaagggtcctgaagtgatagctggatgccgccctctcctttccgatccgttcctccacgatatggatgtcataatccaggaaaatggactggaaatatgcgtggagggacagttttgcaaacttatcaagctggtccggccttgtaatctggcagtggacaataccgtgcctgtggtcctttccgggatgccgtgcaagggccttttcgtaggctgccaggatatcatccagaattccgtcccctatggcatggatggccacctgcattccctgggaatctgcatattccaccatgtcttcaaactgctgcctggtgaaaatggggattcccctggtggatccatcgtctgtatatggctggctgagataggcgctcctggctcccagggaaccgtctcccagcattttaagcgggccaatcttaaaccaatggtttccccagcccgtgttataccctttttccacaaaggccttcagcccgtccagggtagtaaactgggactgttcatagaccctgaccgtcatccttccctctgcatccagttccctgtatgcctccagcacccgctcatagggaacattgttaaaagccagcaaatcatctgtctgggaggaggtgactccataacggttgagggctttggacgctgccagtatcatctcctttatgtcctctttggcgggctcaggcaggcatccgtatatcaggtccattgcattttcccggaatatcccgttaggctcgccgctttcatccacctcatagagcccgccttccacctggggcgtgtttcctgtgatgccggccagccggagagccatggtatttaccacacaggcatggccgcaggttctggtaaggcagatgggatgctccgtggatatcatatccaggtcacggcggttgggaaaccgcctttcatcctcaaagtaatcgtggttccatcctcttccccttacccaggtgccgggctttggggactgctcccggataaattccttcatatattccttcatccctgacagggactgggtgtgctgtgacaaatccgctgcgccaagggcatttccatagttcaaaaggtgcatgtgggaatcattaaagcccgcgcacacaaatcttccctttaagtcctttacctcatctcccggttccttcatggccagggcgtcttcgtcgctgcctgcgcatataaatcttccatcctccaccacaaaggcccggcacaggggaagctccccagtgtatacggctccattccggtatattgtcctcatgtcgtccctccccttattctgccttctccagcttctttttatcctcataaaacagcggcatatccttatcctccagtgttccgatgttcatatagcgggccttgtaatccttcagaagcctgaaatatgtgcctgacagtataagaaccacgaacacattgatgaaagttgggataccgctggtgatgtccaccagggtccatatgctcaaatcacccacatgaatcaggtaaagggtgagcaaaaagggaggtagggcataaaaatacttgaacatgcgcagcagccatttcttcaccgtgggatggttcatagccagatggcgcagggttgcctcatagtacacataccatccgccggaagtggtcacggagaagatcaccatggtggctgtcatgaacacagttccgaaaaatcccagattgttctggaacacgttaagggcaagggttgcattggttgccccggaggtccattcaccggtaatcagcacgctgagcgccgtaatggtacacacaatgaaggtgtccacaaatacctcaaaggagccccagagcccctgctccacgggatgacgtgtcttgctggaggcgtggaccatagggcttgtaccccagccggcctcattggaataaacacttctctgcataccggtggcaatggccttggacaccgtgactccggcaaacccgcccatggcagctgttcctgtaaaggcctgggtaaagatagagacaatggtgggaatcaggttgccgatgttcagcacaatgattaccaggccgaatatcaggtaccccagactcataaccggcaccagcttcacaaatatcttgcttaaattcttaacgcctctccagatcagggcgtagataaacaccactaacagcagggacgccagctcctggggaatcccaaaggactgggccagcacttccgatgtggtaaagttggaggcactgataaaaaaggtggaaaagatgccgaggccgaacacaaaagccagcggaagccatttcttaccccaatggcgctcctccccaagtccatactccatgtaataggtgggtcctccgtatggattcccctcctcgtccgtacggcggtaatacacggccagagtaacctccacctgcttaatcaacatgcccatgaaggctgtcagccacatccagagcacggctccaggcccgcctgtggtaacggctgtggccacgccggcaatattgccaaagcccacagaaccgcctacggccgttgcaatggcttcataagggcttaaaagacccttgtcattttcatcggtgacatggtcctttctcaggatacatccaagggtccgtttaaatatgtaccccagatggcatacctgaaaaaatccggaacggaccgtcacgtagatacccgtaatgataataagcgcaatcagaggcggcccccatatgatttcaccgtttaaccagtttaaaaattctgtcattcttttacttccccctattggttctggattgcgatatcatggctgtccggcacggtacacaaaaagcaatgaccccaggccattgctttccataatcacatatctgcttaagaaaatccagccaatagcgccaccactttaaaaagtgagagtacgcagcctgttagactgcatcccaacacattccgccggcagacagaatccgtttcggcagtaatccctttccctgtgtgctccggcccgccggcctccgggacaaaatcccctctgtccgccaccctggggatggcatccattatcacacagatactaatgcttactgcgcctctatcgcatcctatattttaatattgctttaacatcatactatttaaggctgaaactgtcaacgtttttcgacatttcctgaccgtccctgactgcctgcgctttctgcggttgtcccgcctcatgccagctgtcctgcatcctgccagcttgtcccgtctcacgccagctttcctgcctcacgcctgcggtcctgcctcatgcctgcggtcccgcctcacgccagctttcctgcctcatgcctgcggtcctgcctcatgcctgctgtcctgcctcatgcctgctgtcctgcctcacgcctgcggtcctgcctcacacctgctatccaccgcgcggaccagctttcctgcctcatgccttctgtccaccgcgcggaccagcacatccatcagctcctcaaagcacacgccattagcaatggggatgtcaagctcctccgacctggcgatgcaggcttttacaaatgaggcggccagacgcacagcgctgtccagactccatccccttatggcagccgccgacaccacggaggagaatacatcccctgttcccggccgctcatggcccacgcgcctggttctggggaaagctgtccgctctccctcagccaccacattcataatatagccgccctggttcacacctgtaataatcacgcattccggccccatggcctggatttccccggccagctgcctcagctctttcctgctccatccatcctttcggtaggtccgtcctgtcaggatacacgcctctgtcagattaggagtcacaatatcacccatggataccagctccttcatgcggctgcacatggccggcgtataggtggcgtaggtctccccgtggtctcccataatcgggtctatgattacctttgtgtcctcctgcccgaactgccgtataacatccatcacaatctcaatctgcgcctcggaacccaaaaagccgctgacaatgccgtcaaaggtcagctccagctccttccacttgtgaatgaactcccccattttctccgtgtagtcgtcaaagaagtagaccgggaatcctgtgtggttagacaaaatggaggtgggtatggggcagcactggaccttcattgcggataaaatgggaatagccactgtcaaagaacagcggccgtatccggataaatcattaatcatggcaatctttttctgtcggtaagcactcatgtcaaatctcctgtcatctgaaccggtcaaagagtccggatcttataagtgtactgcgaaggggcatgtagatgactaccgccgcagcggcagacgtcaccgcattgatggaggtggaggcaatgttccatgccagcaccagatccgctgccggtttgcccaaaatcgccagcttgtaaaaatatcccaccaagggatcaaatatcacgttgaacagcagaccgcagacagaggccgccacaacaaagcggaacacatgcctcttgtcagaactctcattgattctgccaatcttgtgggccaccagaccggttatcagaccgatacacagcttcagcaggaaggttttcggcgcgtacaccacatagatggggtcaaacaaatccccgatggtcattcccagggccccgcctaatcctccgtaaaagcctcccaatatcagggctcccaggacgcagaccgcattgcccagatgaatggaggtggcgtctcctccgggaagggtaattttaatctgcaaaaatgtaaataccacataggataatgccgcaaacaggccggtcagggccagcttgtatatacggctgtcttccaggcccctgtggcctgctgtcactgcactggatgtcttcatacaaattctctcctcatattgtagattttaccggaacaactgcattcgttcatgccacctatggtatcactaaagtggaatgttttaaatatccagtttgagaagttttggccagtccagttctgtggaagaaaaatccttttgtccgggttgtcaatcgtgggattccaccacaatcagcaccccgtccgtaaaggtaatggcgccttcctccccctgaagttcattgctgatgcagagacttgtccctatctcaatgtccttttcatggagaggatatttaaaaccggtgagggtaatgcccctgacctcctcagtaagagggaggaaggaaatatatttcccccagatctcacgcctcttaaacgtccgttccttgtcaatgagatagatacggttctggctgtccaggatatatgcctctattcccttttgcaggcagggaaataacagatggatattgcccagcatatggtccatgcgtcctccggtggcccccagcaccaccacctcggtgcacccggtggcctgggcctttaagagggccagctccgtgtctgtctcatccttttccggctggtgggtgtcccatacaatatgttccatcctcctgtaatatgccagcacctccggcttcaccgtatcaaaatcacctactatcatatccggttccagccccagggccttcacggcctccagtcctgcgtccaccgcaatgattttatcaaaggtttcctgtcccaaaaaagaaccggcgaaggacaggtccagttttccgccggttataatcaaacaacgcttcatttctcatattcctttaaaatatccatgaattctctggttctggcagaagggtcccggccaaagacagcggaaccagccacaaatatattggcccccgcctctatgatttcccggacatttcccgcgtttacgccgccgtccacctggatgtccgttttcagtccctgctcattcagcatgtttttcagttcgcgtaccttgtcaagggtataagggataaacttctgtcctccgaaaccaggattcacagtcatgataagcaccatatccagctggcccaggatacactccagggaacgcaccggtgtggcgggatttaaggccacgccggccttcagcccggcttccttaatctggttcaccacacggtccagatgcgtgcaggcctcggcctggactgttatgatatctgccccgcagtccttcatatcctccacatagcgtcccggctcctccaccatcatatgcacgtcaaaaacagccctggtacatgggcgcagactcttgatgaccggcataccaaaggagatgctgggcacaaaggccccgtccatcacatccaaatggagatactcagcacccgccccgtacacctccttcacctgttctcccagacgggtaaaatcagccgcaagaatagacggcgctaatttgtaatacatctctagtacctccttttatttttcaggtcctcatacatgaggatgtaattgtcataccggctgcggctcagttctccccgtttcagggcttccttcacaccgcagacacgctctcccacatggacgcaccccagaaatttacattcttcctcataaggcccgaactccggaaaataatccttcagttctcccggctccagacagtcaataaacatggagctgaatcccggcgtatccatcatgtaggtattctcttccacataaaacaattcagaatggcgggtggtatggcgtcccctctcaatcttgcggctgatatcccctgtctccatggcagcctggggctggatgcagttagtcagtgaggattttccgacgcctgaaggtcccgccagaaccgaggtttttcctctgagaaattttctcatttcctccaaccccgtatcctggtaggtgctgacaaagtggacttcataccctgccctctcgtaaatggcgcggtacttatccacaagcccggcctcccccagatccaccttgttaaaacagatggtgaccggcactccctgaattcccatcatcaccagaaaacggtccagaagattcagattgggttccggatgggtgatggcaaacaccaccagagcctggtccacattggccaccgccggacgtatgaggacgttggagcggggaaggatggcgtcaatattgccttccttctcctcctcgtccaatacagaaaactccacattatcccccacaaggggtttgattttacggttgcggaacacgccctttgccttacactggtacacatggttcctgccgtcattgatataataaaagcctgcaattcctttgattatcttacctgtcatatactcctcttatcccaccggaaaaaatgccaccggataggacttgattactgttaaattgtctgcatccaccacttccaccatgccgctgtccacgccgtacgcccccttgattctggggaataccacgggtacggtctgggcgccaacaaccagtctcggactcataagggttgtgtaaacggaagctccctcatcattggtctggttcaggcgaatcagcacgcgcacgctgctggtctgggaagccggccctatatagttgcttaaggaacatgcctcgtcaatggagccgatgtaatagcgttcatccgctgcctgagtctgtgcaggctctccgctgaccacataatccaccgcagtgcctgggggaagtatggtacccggcagctccgactggctgataatcaggccttcctccaccgtatcgctggcttccacggttacattgcctgtcaagagtcctgctcccgccagaagggcatccgcggatgtgggagtctgtccctgcaggttgggcacacggccctccacgttctgtgagcccttgctcacatagaggctgacgctctctcccaccttcaccacctgggggctgaaacggatcacattgccctttatggcggtatcgctgttctcctccctgacttcaacaaccagccctttctgctccagcagaagcctggcatcttcacccgtcatctgagtcaggtccagggcatttaagtctaccttatcgctgcccttgctgatggtcactcccacagtactccacttcttcaccacagtccctgccaggatatcctggcccatgacctggccttccgtatagttatccgaatactcgctgcctgtgacctccatcaccaggctgctctccttcagtttttctctggccatatcctggggcagtcccaggacgctgggcatatttatctggtcctccgtgctgatatccaccacggtggtggagtcttcggtggtcatggcaacggtctctgtggtaggcttattgctgccctgtctgaaaatcccggtgagccgcgaaaatacgaacagcaccaccgccacaatgatgatggctgccacgatgccaaaggccgtgatgatgcgctcaaactgggtacttacatcatccccctcattctttttcctggtatggatgcggccttcttttttgcgcggttccctggcccggtttctgtcctgatgcccgggctgttcctcctccggttcctccagggcttcctcaggatagctcttcctgccttcctggatgctgttaagctcatcccttgtgatgggcctggtcttgccaaactcatcctcttccccgtccttgcgggcatagatgtctgcgtccgggtccatcagggcagcccgcaggtcctcaatcacatccgtcacgcaggcatagcggcggtccggacgtttttgggtacattttaatatgatctgctccatggcacgggacatgtccggcacgtactggctgggcggtgtcaccggttcctccagatgggccagggccactgtaaccgtgttatccccctcaaagggcacacgtccggttaccatctcatacatggtaataccaaaggaataaatatcgctgcgctcgtcgcagtagcctcccctggcctgttccggcgaaatatagtggacagaacccacggccgtagcgttcatggtctgggaggacacggccctggcaatgccaaagtcagccaccttcaccttgccgtccctggatataatcatgttctggggcttgatgtcgcggtgtatgatgtgctgttcatgggctgccgcaatgccctgccccacctgaagcgcgattccaatggcttccttgctctccagataacccttgttctctatataattcttaagggtgataccctcaatcagctccatcacaatataatggtacacatcctcgtccactacatcataaacacttacaatattgggatgggacaggcgcgccgccgactgggcctccatcttgaacttgcttacaaaattctcgtcaaaggcaaattcctcttttaataccttgatggccaccaggcggtccagggtatggcaacgtgccttatacaccacagacatgccgcctgatccaatccgctccagaatctcataccggttctggagatatgttccgggagttaacatacgcctgcctcccttcctgacggatttacaagtaccaccgcaatgttatcaatgcctccctgacggttggcttcctctataagaagggctgccttttccttaagacttccctctcctgtgatgatttcatacatggactggtcctccagcatattgctgagaccatcggaacagagcagaatataatccccgccctccagatccacctcaaagaaatccggctccacttccctgccgattcccagagccctggtgatgatgttcttgcgcctgttataatcctcgctgcctcttctcatctgtccgatggccaccatttcctccacataggagtggtccctggtgacctgccggatggaatcaccgtggatgagatagagacggctgtcccccacattggccacatagaggatattgtcctccaccacaccggccaccagggtgcatcccatccctttcagttcttccctttttagtgattcttcatacaacatcccattcactgtctcgatgccctttttcagctgcatgacaggagagccgtcccctgccctgtttatgtatatcaccagattctcaaccgcgaaccgcgaggcatgatcgccggccctgtggccgcccatgccgtctgccaccagaaacaggttgggcagggagcccaccttttccggtgaggaataaatgtaatcctggttcatggttctgacccggccagtgtctgtcaaagcatatgcttccatggtcatccctctccttccgtgcattggggtgctgccgaagcttccttatagcttctgcgcagctggccgcaggctccgcctatatcccggcccatttctcttctaatagtaacatttataccgtttttttcaagaagatttttgaaatcctgtatggccttctggcctgactggacgtaatcccgctccttgatggggttgaccggaatcaggttcacatggccgtgctggtccttgataagcttcgccagcgccctggcctcatccagattgtcgttgacgccccggaccaggctgtactcaaaggtgaggcggcggcctgtcttttcataatagtaatggcaggcctccagcacatcctgcagtttatagctgttggccacaggcataagggtttttctcacttcgtcgttgggcgcgtgaagggaaagcgccagggttacggccaggccctcctccgcgaatttacggatgcccggaacaattccgcaggtggagatggtgagactcctctggcttatattcagccccttttcatgggaaaccagccgcaaaaaacggatgacattgtcatagttatccataggctcccctgatcccatgaccactacattggaaacacgttcccctgtgatggactggatcctgtatatctgttccagcatctctgaaggacgcaggttccgttccagaccgtccagagtggacgcacagaaacggcagcccatacggcagcccacctgggatgaaatacacacggaattgccgtgatggtactgcatccacacgctctcaatcacatggccatcctccaggccaaacagatacttcctggtgccgtccacctgggaaacacgctcatccaccaccttcagacaggtaaggctgtaattctccttaagcttctgcctaagcggtatggacaggctgctcatatcgtcaaatccttctgccagcttcacatgcatccagtcataaagctgttttgccctgaaagatttctctcccagggcagccatctgtgctgtcacttcttccagtgtcatggattttatatctttctttccgttgcagtccaataaatccagcataaaaactccttccaaaacacgctctaaatcccctccgggcctgtttcaccctccgcacgtctgaatacgctgatgaaaaacccgtcatagggatgcacccccggcaggaactgaatccatccgtcctttaacgaggactcctggggcagtccaccgaaccggtccgtcaaatccaccggcacaagcggaaaccgttcccttaaccaggccgcattgtcctggttttccagcctgtcaatggtgcaggtgctgtagcataggagaccgcccggctttacgtactgccagacaacagacagaatctccctctgaagccctgccagctcctcaagcttctcaggcgtcatgttgtacttgatatccggcttcctcccaatgattcccagaccggaacagggcaggtccgctatgacgatgtctgcctttgccatggctgacggatctgtctccagtgcgtcccacaccagggtcttcatgttggtcacgccgcagcgggccatattttcctcaatcagggctgtcttctggtatgtaagatccctggcctccaccatgccggtgccctccagcttatccgccagatggagactcttacctccgggggcagcgcacacatctatgatataactgtctttttcaggggacgcaatctcccccacaaaggcggaggtcacatcctgtacctgtatccagcccttcctaaaggcatccagtccctccagataatcgtacccgtcaatggctatcatggactccatgaaaggcagctccctgaccgatgtcccctgtgccttaagggaggccagaatgctctcccggtctgcccggtgcaggttgcacctgacccaggtaggcttatcctcaagaaaagaggcggcaatcttctccgccttttctttcccaaattccttttcccacatggcgtacatccactcaggaatactgtaccgcagggagggagtgtcaaaggtcagattctccttttccctggaaatggtccgcagcacgccgttcacaaaacccttaagcccggagaaatgacgcttcaccgccagcttcaccgcttcattgcagacagcggaatcaggcacgcggtccatatataatatctgatatacgctcatccgcagaagactgcggatgaacggcttcatcctgtttatctttgtcttggaataccggtttatgacctcgtcaatctgtatcaggtattccagtgttccttccacagcgcgtgtgataaaggaacggtccgccttgcccaggtactggtacttctgcagggcctggttcagtacaaggtggacaaaagcgccctgttccagtacctccgtcaatatatccaggacaatttcccggttttccagtcctctgtctaaggtctttgccatctgaattttctcctctcagggcctgtctgtacataagtccccataaaatctgccgtacccggcgccttaatcattcctgcggttgccgaataatatcagcaggcggagaagctgaaggatggaagcagccgctgccgccacataggtaagggccgctgcgttcagtacctttctggtctgtcccacttcctgtccggccaggatgccggtggaatccaaaagagtcaccgccctgtgggaagcatcgtactccacaggcagggtcaccagctggaacagcactgccaggcaaaacaaaaggatgcccagattcaacaggacagagcttcctcccagtaaaagtccgatgataatcaggggccagcaaagctgggatcccagattagccgccggcaccagggccgcgcgtatccttaagggcgagtaatcattggcatcctgcatggcatggccgcactcatgtgccgccactccgatggctgcaatggatgtggaattatacactgcgtcggacaggtttacggtcttgcttctggggtcgtaatggtctgtcaggttgcccggtacccggcgcacggtcacgtcataaattccctgattggcgagaagccttttagctgcatccgcgcctgtcatgccgcacatgctcctgacagcgctgtagcgctgatacgtggagttaagcttggcagaggctgccatggatatgactacgccgatcaatatcagtacataggttgggtcaaaataaaacatagggtaaaacatcatcaatcactctctttctttacaaacacgtcccccgccgggatgggatatcctcggagaaatgctggggtatccatgcgtttttttccttccatctgaagctccctgatggacagcaggccgccgccggtgcagaccaccagtccccgcttatccgaacacactaccgtgccgggagcagtccccgtttctgcgggaacacctggttcggacagaaaatctgccgcctcccggcctgcaatcacatctgccgcccatatctttattgtcttcccattccacatggtatatgcactgggccacggatttaagccgcgaatcaggcgttcgatggacacggcgccctgattccagtcaatgtccccaagggactttgtcagcatctttgcatagcaggtgccttcatctgtctggggtgtgcggaccagagtgccttcctccagcttcttaagggtggataaaatcaaatctccgccagccatggaaagcttgtcatgaagactgccgccggtctccttttcctctatggggattaccgccttttccagcatatcccctgtatccaggcccacatccatcatcatggtggtgatgccggtctccctttcgccgtctatgacacaccactggatgggtgcggcgccccggtacttgggaagcagggacgcgtggatgttgatgcagccgtacttcggaagctccagcactgcctttggaagaatctggccaaaggctatgaccacatacacatccgcctccagtccctttaggacctccacaaaggatgcttcccgcaccttcgccggctggtacaccggaatgccgtattccatggcctgtattttcacaggtgtcatctggacttcctttcccctgccctttggcttatcgggctgggtgaccactgcaattacctgatgaccggcttccaccagggccttaagggcaggcacggagaaatccggtgttcccataaatacaatgcgcataaactatactcctattctatgatttcttcctcgtccgcagccgtatccaccagttcgccttccaccagctccacatacatctgtccttccagatgggcgcattcatggcagatggctctcgccagcagcccctcgccttccagctcatagggctccatattttcattaagcgccttcaccttcacgtagtttgggcgggtaacgatgcccgacttgcccggcaggcttaagcatccctcgtagcctgtctggctgccgtcggtggctgtgatttcagggttaatcagtacatactggttcccgtcgtccacatcaatggttacaatctgcttcagcacccccacctgcggggccgccagaccgcatccgttggcctggtacatggtctcaaacatatcttctatcagctccatggtgcggtcactcatcgccttcacgggcttgcacttctttgtcaaaatttcgtctcccataattcttatctgccgaactgccatctcttttcaatctccttcatcatgttaaatcgtactgcacagtcagtccatcacggccttctaaccccttcaggccctcttccgtcattttcctaatctgtatcagtatatcataattttcatgcttaatatataaaatttttctataaatatcattaactttgtataccgctgcattgaccggtcctatgagccggaaagacttgtatccctgtactttttcccgctccatgcggtccgcccactgctgcacccaccctgccgccaaatccgctgtctgcgccagggtcccttctgcaggacacgccatctgcacggtgagcagggccactgccggaggataacccagcagccttctgtaagccatctcctggctgtaaaagctctcataatcctgggtggccgcggtgcgtatgctgtaatgatccggctgataggtctgtatcaccacatttccggccagctgccctcttcccgcccgtccggctgcctgggtcagaagggcaaaggtctgctccccgcacctgtagtccgaggcataaagggataaatccgctgccagggcgcccaccagggtcacctttgaaaaatcatggcccttgacaatcatctgggtgcctataagtatatccgcttctcccctggcaaaggaggaaagaatctcctgatggcctcccttttttgaggtggtatccaaatccatcctgagaatcctggccttggggaaaagctctgccgccatggcctcaattttctgggtcccggtgccaaaaggcgctatatacggggagccgcagacaggacatttcttgggctggggaatggaatagccgcagtaatggcacatcatgcgcccatcccggtgcagtgtcagggtcacgtcgcagtgagggcatctgacggcctcgccgcaggaacggcaggacacaaaattggcatagcccctgcggttgataaacagcatgacctgctctcttttctccagccgttcctctatcagcgccttaaggcgcctgctgaaaatagagcggttcccctcctttaattcttcccgcaaatccacgatctcaacctggggaaggcaggcatcctcctttgccctctctttcagggtaaatagcccgtactctccccttaaagcccttgtgtaggattccagggatggggtggctgaccccagcacaagggaggcttcgttcatctgggcccgctttgcggccgcctccctggcatcataacgcggggacagttcgcttttataagcattttcatgctcctcgtcaatgatgataagccccaggttttcaaagggggcaaaaagggcggaacgcggaccaatgacgatgtcaatatcgcctgtcctggcccgttcatactggtcgtaccgttccccggcagacatccgggaattcatgaccgacacccggttgccaaaacggctgtaaaaccgcatcacggtctgccaggtaagggaaatctccggaatcagcacaatcacctgacgtcccgccgacagcacatgggcaatgagctccatataaacttccgtcttaccgcttcccgtcaccccgtgaagcaaataggtacgccggattccccggtcgtattcccctatgacagcatccgcgatctcccgttggaaaggattcagttcagggggagcgccccacagtcctgattcctgatcatccgaaacagcctggttcctctcccggctgcccatgagctgcttcatttcctccaggggattccggtacttttccaccacctccacggcaatgataccggcctccaaaagaggcttgatggctgacggcgtaaggttcagccggttcatagcctcctcatacggaatagcgcttgtcagaagcagcgcctctaaaagccgcagctttgccttatgcttctttctcccggcttcctccgccagttcttcaagcacacccctgcccaccagggtacggattctccgcttgggagcctccctgaccttttgttttacaggcaggactgtttttaacgcctgattcatggtagagccataccgctccttcatccaccaggccagccaaataagctgggactccgcagccacgcttccctgcacaatcccagccacatcttttagtttatggacatctatctgggcctggtccgtcagatccaccacatagcccctgcgctgtctgtttccctgcccaaagggtatgcggacctgctgccccacctgaatctttccctgaagctcctccggtattctgtactggaatgtcctgtccacattttcatgggaaatatctatgataatactggcatatctatgcgccacttacgtcacctgtctgtcttgttattttgtacttggttattatacatgagaattgaataaaatgcaaatggggggatgggacgcaaacggggatgggggatcgcgtccgtgagagggagacggacgggggcgggattgatggttttcgcgatggcagggactaagacgccggggcgggccagaggggaggatcgcgaaaactgcgcagaactcttgatgagttctgctccgtgttcactttgctccgggcgttgagcgccctgcgcaacctcccctctggcccgccccgccgcctaagtccctgcgaaccgctccaaattcaatcccgcccccgtccgcctccctctcacccactgctcttttgacgtttgctggttcttccccgccaagggagtgaaagatactgctcgctgggagtattctttattgggattggcttgttttagggcttgttttggggcttgttttggggggagtggtttgtttttggaatatgtctattgcatggctggtgatgcctgtcaggtctttgcgttcgcaggtggcatagtggtattttaagtataattggaatgtttcatcatccattttgtcgattgcttcccggatgagcagcgcacagccgtctgctgctgcgtaatgcaggcgcgttgtcgggaatatggacatcaaatcgtcgatgtcttctttacgtacaagttcaaacagatctttgggctcggatttggcggcgaatgtttcggggtccagcaggccgttttttatgtattcggctgcattgatattgcctcggttgaatccttcgtccagaagacagccgtcggatatgacatatgctgcaaagatgatgccgccctgttttgtgacgcggatggcctcgcccagcgcctggcgcttgtctttttttgtgtatagatggtataagggccctaacagcagcgtgatgtcgtattggttgtccgaaaaggctgataagtccagcgcattgccctgggtaattgttatatgttctgccggcagcatatgactgcaaaatacttctatgttatgggggaccagttctactgcgtcaaccgtatatcccagacgcgccagcgcatgggaataccggccggttcctgctccgatttcaagaacacggctgcctggttttatgtatttttctatgtagcgcatggttgtaagaaattccacggtcccatgccttgggctcagccggctgtcctcgtcatagttattataataatcaatgatgtatggatttgttttcatatcgcacccctatgttatattgattcggttataccgctaacggataaggcccagtccggtttttcctgtcttatgagagctgtcagcatatttgcagccattttttctatatggcttctgtccagtgttattttttgcgccgctgctaaaaccgctatgccgtgggaataaagaaataaatctataaagattgcctttgcccgctccggctcgattccaatggtatcagaaaataccctttccctctccccgttgcctgcctccatatagaaatcctttggctccgccatactcaaatccatatggtttataaacaacagcctgaacaaattcgtctcctctctcgcaaactcaatgtacgaaagcggcagaaccagacatggatttatgtgttccaaactgctgtaattctccacatactgactgtaaaactcatatgcaaagtcaagaaattcctttcttaattcctccatgttctcataacatgtaaaaataggccgcgtggaacattgtagtctgcccgaaatacttctggcattaacagactcaaatcctgcctctcttgtaatctccagaaccgtattcagaatcatctctttcgttatctttgctttaggcggcatcggcttacctcgctcattgtcatattatatcagcagcttaacacatgtaccatcacatgcatcccaccagttacaccacatccgatatgtcacaaaatttgtgcaaaacgttatgcaacaaacgttatacaactattgttgcacaacaatcaataactgtcaagccctattcaatcttttataatttatttaatattttataatttatactcccccttcctcactaaaaagtgcggttcatccatccgcaatggaattaaccgcacccaccagcaaaacaataatcttctattttaaaaagcatcaggaaatacccagaggaaggtacacccatttctctgattgtgcagtgaagtaccgggagacctattatacgtagtgggtgggagcaagggggaaggaagctggggatgcatctgcaggggcttagtcggtcttagggggtggaaaaaggcgttgagagtcagaccgcacagctgtctgagcgcagcgagtttgggcggtctgactcttgctttcagtcgttttccagccccttagaccggacttgccccgaagccgtatccccaggttccttcccccttgctcccacggacgcgattccaccgcctcccgcaacctcccactcccaatccactcactccacaacccccgctctcctctcaaaccccttaaaccttcccgaaaacatcaatgccctgaatatccagtcaatgaacatgccgtaccataccccggaaagtcccaggtcgaatatgtatacaaagaggtatgcaaacccgatacggaatacccacatggagaatacggacacggccatggtgaatttggcgtccaaggaggccctcagggcatgagggatggtgaaggccaggggccatataaccatggctatgctgtggatcaggatcagctcacgggccataagggctgcctggggggacagatgatagattcccaccagcggaccggaccagatgaccatggctgtgctgaatacggccaggattccatagaccaccataataagggatttggtgtcgctcttggcctccttcagacggcctgcgccaacgcattggcccactatggtcaccagtcctaagccgatggcatttcccggaagatagagcacggtcaccaggttgctggccacggcaaagctggctatggatactgtgcccagggaggagacaagactctgaaggaatatcttgccaaactggaacatgccgttttccagcccgttgggaattccgatggacaggatattctttatcatatggcggtccggaatcaggaacttccagctgttgagacgaatggtattgttccggttctgtataaggacaaacatcataaaggctgctgtcacacggcttatgaaggtgggccaggccactccggccacccccatcttaaggccgaacacgcagattgcgtttcctataatgttaatcatattcatgacaaaggaagtcatcatggatacctttgagttgcccatggaacggaacagggctgcgcaggcattgtagagtccgataaagggatatgacagggctgtaatccagaaataggtctgggcgttgtccattacatcctgttccacttttccaaatatacctcccagcaagtggcgtccccctgcaagagctgtcccggcaatgatgactgagagaagcaaggtcaccaggaccagctgcccggctgcctttctggcatccctgggctgctccttgcccaggtactgggccgatataacggcgcctccggtagccagggctcccatgatttgtatgattaagacgctgatggaatccaccagggaaacgccggagaccgcggattcccccactgcggccaccatcaccacgtccaccattcccaccagcactgccatgatttgttccacaataaggggagccagaagttttatcatttgttttctggaaaacatatcttacgttcctctttctctcatagttccagcaaatacccagccataatacccggaggcgctttttcctctcaggtctgtggctgggtatccgtgggacaggccaagggcctgccctttattgtttttctgcattcattaccgcacttcgtagctcccggaacccatagccttcatagaggtgctgtagaacctccttgcggcccgaatcagataacaggtatccttgattcccactgtctcgtagggggaatgcatggacagctggggcagtccgatgtctactgtgttcacagccacatgactgttggaaatatttcccagagtggagcctcctgccttatcggaacggttggtaaatgcctggcagggtactccctcttcctggcacagtgccctgaacacggcagctgaaagtccgtctgtggcgtactttgtgctgtatttgatgacgattccctcattcatatagggacggtttacgggatctgatttgtctccatggttggggtgggccgcgtgggcattgtcagcggagaccatgaagctggatgcaatggccatcaaatactcctcctcgctccttcccatggcgctgttaatccgcctcagcacatcttccaggaaggtggagtcagctccctgcttggtcaggctgcctatctcctcattgtcaaataccgcgtgaacacttacacactccggatggccgccctccaggaatcccttcaaggtggaatatgcgcactgcaggtcgtctaaatggccgcaggataagaactccccgccggccccccagatactaccgggcacgcggttgtagagatagagatcatgtcccaggatatcctcctttttgacccctgcgctctcagccacagtttccataaaggttccctttgcgtccgcgccgccgtataagggcagcatgtctacctgggcattatactgatagccctcattgacctcacggttaaaatggatggccaggtttggtatcataagcagatcgcggtccacctttaccagctttgtggcaatgcggtttccctccttcactgccagacggcctgccacggaaaggggacggtcaaaccagggagcgcacagcataccgccgtatttctccacattcagcttcacatagtggttctctgcctctatctccggattttccttgattttaaaggagggggaatcactgtggctggccatgatctggaaaccggaaaatgcctttcccggcaccttaaaggacacaatggatgaaccgttcctggtcacatagtaggatccgccctctgtgagctcccacttttctccctcatgaagctgtgtgaagcccgcctcctcaagacagtccgcaatggactgtaccgcgtggaagcaggtggggcttttttcaagaaaaccgatgagttctttggctgtgcttaagcagtcttctttgtctatattcatatgatatctcctttgtctcttatttctcctctactgtaccataaagacatcgccacggcaatgcgggaagcttaactttttttctcctttgctgccatccatggcataatgaacccaagtcctaccagcacaaagggagtcacgatattcagagccagctggaaggggtcttctgagtaaatacctgtcagacatgcaaaggccgtgaatagaaagcaccagccgcccaccaggatgcctgctgtttttcccttcacaaacctgtactcgccgcagaacgcatccccggccctttttaaggcaatgtatgccacaaagacccacagatatcgcaggggcatgcacaccgagtttaccttgaccagccagcgcaccagagcgtccacgttcctgatgccaaaggcaggaaccacaatcagcacacagacaatgagcgtcaccagcctgtgtccgttcacataggtgccgtgttcatttttctcaaacatcttgccggggatgaagcgggaatccgcactgtccaaaagcattctgaggggcgcgtccacggacaggaccataacggaaaactgtccgatcagattggtcagcgcgtataccaccacaaagaaattccccacatggtaatattcacccagcttctggaacgcgtagtaggccccgttggtcatcaggtcctggggaatatgattggagtcaaacatcatgcccagggcaatagtacccagaatggcggtcacggccaccatggctgccagggctaccatgccctttgcaaaatccctggaaggatccttcatcttatttacatagggggaaatcttctcacatcctcccaccgcaaaaaccaggatggaaaggctcagaaaaaaattggcgttaaaatccggtataaaggacgaaggggaccagtcaatggctaataaggcaccttctgtcagggccggagcagccaccatcatgacaatgaacagcatggacatgatgaacatggcggaacctgccaatgtggcaagcctctttaacacccccatccccttgccggacaggtacatggcaaacaggaaaatgaccaggcacagaatctgcatcaccgtggtgttcatgccgctggccctcttgtcctggaacagggcccagctggctgcaatcacagtggaattcggcttctgggatatatagggcatgtggaccacccagtaggtccagcctgcgtagtaagccatcttgggccctatggtctcatgaatccaggagctgaccccgcctccggtatgcttgaaggtggatcccagctctcccaccatcagggcatagggcacaaaataaatggcaaatataagaatccaggatacaatggcctttaatccgccgtattccgaaaatccgtttatcacattcccaaatccccagaccgttgaaaaagccataaaagccagggtatgccagagaatctttttatcatctttctgctgcatcacaatgtttctccttatctcattcagaatgtactttctgtgacatttctgtccatatcgtacattcttcccaaaatgagggaaagatataagcactcagatagaatcatgacctggtttccttcagatgatttactgcctcggacagcttcatgctgttggagcctttaaaaagaatgcagtcgccctccctgatgttttcgtccagccactcttcagcctgggccagactgtctatttcaatatggggcgtcgctgcgcgggctgcatccattcctctgccgatgcaggctgccagctccccaagcaaaagaaccatgtccaggggatgttctcctatgtaggcgcctatttcggcatggaacctttccgtatccgggcccagctccttcatgtcggccaagaccgcaatctttcgttctcccttcacgctgtccagcacctccagtccggccttcatggacaccgggctggcattgtagctgtcgtcaatgacagtgacgccgccccattcaaatatctgctggcgtcccttgtagcccttaaactgtcccagggccagtgccgccttctccatggaaagcccgtatgtatccgccactgccagggccgccatggcattgctcaccatgtggcttcccataaccttaaggcgcacccggaccctgcagtcaccgtgaaccgccgtgaacacgggatacccctcttccaggtgcaggtcctctgccctgtagtcacagtccctgcccagtccgtacagcaccttcttcctgccctccttcggaaccactgaggccagaagagggtcgtcgccgtttaagaacaatatgccctctggcggcattccctcctggatatggagcttttcctccagaatgcattcctgtgatcccagctgttcgatgtgggctattcctatgttggtcatgacggcacagtccaccctggccaccctggcaatacgctccatctccccgggttcgctcattcccagctcaatgacgccaatctcagcagactgcgggatttccgcaatggtaatgggcacccccacctggctgttgctgttgcccggtgtcttatagaccttgaatccggcgctcagggcctccgctatcatttccctggtagtggtctttcccacgcttcccgtgattcccaccaggggaagactcaggcgtttcctgcaaaaactccccaggtcctgaagggccttcttcgtgtcagacacctcaatccatgctgcctgaagtgctttcctctcctgctccctgttttccccgcactgctgccggacacaggctttaacatcctccccgcagtgatgttcgctggtaaataccacggccgccccgctggcaattgcctggcagagaaagcggtgggcgtccacccgctcacccactatgggcacaaacaggtcatccccctccatttttctggaatccaggctgatgtgtttaacatgctgatcctcctggccatgcagcaggtttcctcctgtggcttcaagcagttccttaaccgttattcctgtcatactgtgtctcgtctcccaactcttttatggtttcttcaatgacttccctgtccaggaaatgatggcgcacgccgttgatctcctgatagtcctcatgtcctttgccgatgacagctatcatatcccctggctgcgcatgaaggatgctgctgcggattgcgtcccttctgtcaggaatttcaacaaagtcccctcctgttttttctatgcttccccggatatccgccatgatgtcctccaccttttcatacctggagttgtctgccgtgatgatgcttaaatcggccagccttcctccaatctcgcccatagagtagcgtctgtccttggaacggttgccgccgcatccaaataccaccaccagccgcctgggatgatactggcgcagggtggtaagaaggctctccatgcttaccgcattgtgggcgtagtccaccaggaccgtacacctggatgaggtgtggacgatttccatacgtccattgacacgtatgtgctccagggcgtggacaatcctatcttttggaagtcccaggaaggagcatacgcacagggctgccagggcattgtccacgttgaacaggccgggaattcccagacggacatccatgtccaggttccctgtgacatcaaactccgtgcccacaaaatccggccgggacacataccggacgtttgaggcttcaaagtctgccttcgtctccccgtcctcctttacgcggtacgtataaagccggcaggacgcgtcctttacgatttctttaaaatgcccgtcgtttaagtttaccagccctatcctgcacatgctcaaaagacgtgatttgcagcagagatattccgcaaaatcagcgtgctcatccggcccgatgtggtccggggatatattggtgaaaatgccgtaatcaaaggcgaggccgtccacccggtgcatcttgattccctgggaggacacctccataatcatatactggcagcctgcctccgccattttcgcaaaggactggtgcagttcataggattccggcgtggtattcatagtaggggtcacctgtccattgatcaccgtgcctgtggtgcctatcatccccaccttttttcctgccgcttcaagaatggcttttatcatatgggtggtggtggtctttccctttgttcccgtcacgccaatggtaatcattttggacgcaggataaccgaacctggctgccgagagaagagccaggcttctcctggcctctgctgtcttaagtattgtcacccggcccatctcatcctccgcaagtcctgaggcagccaattcctcctcaatgtcccgctccgtcacaaggacgcggacgccagcgcgcagcacatccggtacaaaccggtgggaatccacccgggtccccgccatacacacaaacacagcgccgggcactgcctttctggagtcgtagaccacctctgtgacctccacatccaggcttcctctgacaagttcataatccagctcattcaaccaggttctaagtatcatatcaatacctcatttctttttcgtgcaacttatattatgccaaaatatatcctggcccggcgctcctttttcggatgcgccgggccaggcccatttcctagaaaagtccggtaatcttaccgttctcgtccacatcaatgctgtctgccgccggtttcttcggaagtcccggcatggtcatgatggaacctgtaagcgccaccacgaagccggcgcctgctgatacataggcatcccttacattgatggtaaagccggcgggccgtcctaacttggtctggtcatccgacagggaatactgggtcttggccatacacaccggcaggtttccaaagcccatatcctcaatgcgctttaacgccttggcagcggccggtgcaaaggaagcgccgtctgctccgtaaatctcttttgcaatggtattaatcttatccttaaggctcatctcatccggatagagtacatggtactgggttggcttgttctccagtgtctccattaccttttcagccagggcaatgccgccctcgccgccctttgcccatacctcggacagagcgaactcacatcccctgtcttcgcagaacttcttgatataagcatattctgcctcggtatcggatatgaaggaattgagcgtaaccaccacaggcacgccgaacttctggaggttctcaatgtgcttctccagattcacaatgcccttttcaagggcttccagattctcagctgacaactggtccttgggcacgccgccgttgtacttaagggccctgaccgtagccaccagaaccactgcgtccggcttaagtcctgccttgcggcacttgatgtcaaggaacttctcagctcccaggtcagcaccgaagccggcctctgtcactaccacgtctgccagcttcagggctgtcttcgtggctctcacgctgttgcatccgtgggcgatgttggcaaacgggccgccgtgtaccagggcgcctgtatgctccagggtctggatcaggttgggctttaacgcttccttaaggagggctgccatggatcccactgcatggagctgctctgcggtcacaggctctcctgcaaaattataggccacaataatcttgcccagacggttctttaaatcctccatgttgtctgccaggcacaggatcgccatgatttcagaagccactgtaatgacaaagtgatcctccctgaccatgccgtctccctttgctcccaggcccaccacgatgttgcgcagaacgcggtcattcatgtccacgcagcgcttccactggatctgtcttgggtcaatccccagggcattgccctgctggatatggttgtctaagagagctgccaacaggttattggcggaggtaatggcatggaaatcacctgtaaaatgcaggtttaaatcctccatgggcacaacctgggcataaccgccgccggctgctcctcccttaacgccgaagcaggggcccagggacggctctctgagggctatgatggccttctttcccatctttccaaatgcctcgcccagaccaaccgtggtagtggtctttccttctcctgccggtgttgggtttatggctgttaccagcaccagttttccgttgggacggtcctttacctgctcccagagttcatctgtcagctttgctttgtatttaccgtaaagctccaggtcatcctccccgattccgtaagcagcagccacttccttaatgggctgcatcacggcctcctgcgcaatctcaatatctgatttcatatttttgttcctcctcttatattacgccccacggtttcccgcctttgcaggtccgtcaacgttttattcaaaagcaccggccgctgctgcccttgccggcagccgctgctcttgtttccccatacatccctgttcccctgctccggcccgcatgcgccgcgctttcagggaacagtttctaatacccctgctccagcagttcctcgaattcttccatgctcataagcactttcctgggcttggtaccctcttcctcgcccactacccctgcttccgccagctggtccataatccgggcagcccggttgaagccaatcttaaacatcctctggagcatgccgatggatgccttttctttttcaatgataaacctgccagcctggacaaagtactcatcccgttcagaagccccgcttcctccgtccatggacggggaagagacacggctctccacttccggattatattccgccaccatgccctgttctgtcaggaattccaccacccggcccacttcctcatcggacacaaaggcgccctgtacacgctggggtttggggaatccagccggataaaagagcatgtcgccctttcccagcagcttctcggccccgttcatatcaataatggtcctggagtccacgcctgaagacacggcaaaagcaattctggacggcacattggccttaatcagtccggtgatgacattgaccgacggcctctgggttgcaataaccagatggattcccgccgcacgggccagctgggccagacggcagatagcatcctccacttctcccggagccaccatcataaggtctgccagctcgtcaatgataatgacaatctggggcatctttaccggctttttgtcatcctctatatcctttatcttttcaactctttcattgtagccctttaaatccctgacattgcactccgcaaacttcttatagcggtccgtcatctcggccacagcccagttcagtgcccctgaggcctttttggggtctgtcaccaccgggataagcagatgggggattccgttatagacactgagctccaccaccttggggtccaccataatcatcttcacatcctctggtttggacttgaaaatgatgctcataatcagggtattgatacacaccgatttaccggaaccagtggcgcctgcaataagcagatggggcatctttccgatgtccgtcaccaccacctgtccgccgatatccttgccaacggcaaaggccagacgtgacttgtggttcttaaacgattccgcctccagcaaatccctcaaatataccatgttgttctctttgttgggcacctcgattcccaccgccgacttgccgggaatgggcgcctcaatacggatatccgccgcagccagactcagcttgatatcgtcggtcagccccactatcttgctgaccttaacgccctgctccggcaaaagctcataccgggtcacggcaggaccgcagcttatatttgtaaccgtcaccccaacactgaagttatggagagtctgctgcagtttaatggccgtggccttatactcatccccagaaaaggaaccggcattcttagcccctttcttaagcagggtagtaggcgggaacacatattccttctttaccgcctcttccttttccttgatttcctgggccaccgccatattggaatcggtctgtccggcctcctcccgcttcttctcaatctttttctggagaagctctgtctcagtctctataaccttgcctgatgccgtaaccacccgcttgggctcctccggcacaaatatgctgtcataattgataccctgttccgacgggtctgtctcatagacatctgtttccggatcatccgtttcaggaattcccgcctcatggtctgcggctccgtgcagtcctgtcccgtgaaggccggccgtacccgcgctttcagcagacaaggcagctccttctgccatatccccagatgtcccatattcttcttcccagggaaccgtatcctcacggccccggtcatggccataaccgtctacaggattctcgtccctgtccgcagaggacctgacatgaaactccatctcctccagggtctttaaatccttcttcacatggatggtgtcatagtcctccccatcatgtgtcccatactcgtcctccacaagaatgccggtgaccaccggcgcttcttcccggcgtcccaaacggctgtggccctctatagacctggccagggcccccagttcatccgtgtcgtaggaatccccggcatcggtcccagactccaagggcggatcaaacctgcccacaaactcatccggcggcaggctgtcctttgcgccggctgtctgggccggcccccagtccttctcgtatgtatcgggcatttctggcatttccggcatttcctccagatccgctccaaactcacggtcaaatgcctcctcgtcataatcctcttcctcaggcgtcatcagcctggtggcattcagattaactcccctcaccctctgttcctcgcggatgcgcctgcgctcctcctcccgcatggcgtgaagctccctgcgccggtccatatcctctctggcatactggtaagccttgtctcctccccgcttcacagcagacacaaaggagcgctccgtgatgcataccatgcagatgatgaacaggaccaccagaaccagaaaggttcccggcttccccagtccgatggtaaggaaggaggtaaggacgcctcccagccatccgccgcccgtaccggtcagggtggactgcttataatattccatccacttcgcgccggccggaaccgtaccgaaggccagctgcagcagcccgcagaccgtaatcacagcccctgccacggctgccagcttcatggcagcatggatgtttccctggttggacagatggaaacaggtgcccacaaatatcagtatagggaatagataccccaccattccaaatattcccagctgtactccgcgcagcacatcgcccaccacgccgcacagcttgaaattgctcagaaataaaagaatggcaacagcaaaagagcagatgatgaccacttctgctctcatgaattccgtattatcctgttcataggccttttttccggttgtcccgcggcttttggaggaagtgcctgtctttttggacgtgcttccctttggtcttcccggttttctgttcccactctgctgtcgttttgttgtttcagccacttgatacagcctcctgtcattctcttacaagttgtcataccgtatcagcctcccattcccacagcaggctgtctcatttatacagttaacttatattatgctatatttgaggttaaaattcaagtggattgtttcaaaagacggaatctaccgcctgcgttcccgatcatcaatcatggcataaagctttccaagggcttccttgatgcctcccacctggttgataagtcccgcctccacggcctggtttcccaccagaacagtgcccaggtccctggtcagcatctttgtattatgcatcaactccctcagctggtcataggcgatatcggcatggtttgatacaaacgtcagtatgcggtcctgtatcatctcaaaatactcataggtctgggatgtgcctataaccatccccgtcatccgcaccggatggatcatcatggtgccggacggcacgatgaaggaataatttgtggacacggccaggggaaccccgatggagtggcttccgcctaacacaagcgatacggtgggaagactgagggacgcaatcatttccgcgatggcaagacccgcgtccacatcccctcccgatgtgttgagcagcaccagaagtccgtccacactgtcgtcatcctctatttcagccagcttcggcagtatatggtcgtattttgtggttttgctgctcccggaggaattctcatgtccctccacctccccaatgatcgtgatgagatggattttcctctgcctgcggttgtcctccagaatgacctggccatactcctccagcttattgtcttccttttcttctatttccttttcaagctttttggcttcatcgtcctgctggcgtacctgtccgtttccgttttccgcctgactgtctctttttttcctgttgttttttccttgtcccataatcagaccaccctttcgtgaacattcatcaattaaggatagtctgcaccgtgaaccataaaatatgcgctgtcttttacagagtttcgtgcaaaaataaccggccagcagagactgctgaccggctttctgaataaaataccattttttttaatctagtcgcccaacacattcctgatagcaacaggcgacctgtaattccaggtggaaatcttgataccgctcttacggctggccgcatggactacctggccgttgccgatgtagatggctacatggtttacctgtccgccgctgcccgcgtagaatatcaaatcgccgggacgcatgttgccggaggtaaccgccttgcccatcttggcctgggagccggaataatggggaagggacacaccgaactgtttcatgacctgcatggtgaatccggaacagtccacaccctttgtcaggctggttccgccccatacataggggttgcccacaaactgaagggcgtaattcaccactttggaacgcctggacgccgcgttgttggccgccacctcagcaggtgagaacttgatggcctcgttcagcgcgtagcgcacctccacgttgttgtccctggtggaaataaacgccttatccaccttgcttccgtcctcttcatccacggaatccagatcaatctccacccagccgtctaactgggccacaaccggataacgctcgtcctttacaatctgggtccagattttggcctccgtattgggctccgtgcgcacattcagcacgtctgtgttgataaccgccttgagggtggcgttctgcatggctatatcctttgcctcctggcctgtggccgtgtactgggggtctgccgagatataaccgatgatggggcctgacttaatcttataccagccgtccagggtctccaagatctcgcctgccgccttgctggtcatcttacctataatcttgccgtctgactttggctcctggcgcacgttcaggtagttgttcaccttggaaatcaccagattgtcatactggttgatggccatggccttcatatccattttacgtccttcgttcagggaataggccacctcagcatattcagaggaaatatatccctcttctatctgaatccagccgtcctccaatcccttgaccacgtagcgctctccctttaaggcctgtccgataacatttcccggatccagggcaggggcctgacggatgttcaggttgtcagccgtcaccgtggcacgcagcttgacaagctcctttgccttttccctggcttcgtctccggtcagaaggtactggttgctgatgtagccctccactccgccggaggtgatgtgggaccagtccccttccgtcgccagaatctcgcaggctccgtctcctgacagcttacctatgatcttgccgtcagtgcttggagtctcccttatgttgaggtaaccggacacctgcacgatacccagattgctgtaggagctgattacattgtcaatctcctgggcttccttctgagctgcttcctcctccggggaaacactggccggatccgcctgggccggggtggcgtttcccacctgtcccgtgggggccggtcccgctgctttgccggataccggcttcttgactgcctttactcccagcacaatgattcccactgctgcgatggcagccaaaagaagcaccaggtatctggggtccagacgttgattccgtttttttctggccttgttcaggctcgatagataatccttatgttcaagcatgattctataatctccaactcattattcgccataaaagctcatatgacgttaagtatatcataaaaacagactcgaaaatgtgaaaaatttcttaaattttgccggtccccgaagtatttacatgaaatgccccggaaaccggcaattttaccgcctgatagagattactttgagagcagcatgcggtcattggcaaactgtcctccgctggcctctgcaaacttggcaagaaggtcctctacggtcaggttctgcttttccctgccggatacgtcatagataatccgcccgtcattcatcatgataagccggtttcctatctggatggcgtccttcatattatgggtcaccataagagctgtcaggttctgctccgtcaccatctcattagtcaggtccagcaccttcctggccgtctgcgggtccagggctgccgtgtgctcatccagcaggagaagcttgggcttctgcagtgtcgccatgaggagggttagggcctgtctctggccgcctgagagcagtcccaccttactgctcatgcggttctggaggcccagtcccagcctggtcagcaggtcgcggtaatagtctttctcattggccctgattccccatcccagccctcttttctggccccttctgaaggccagggccatattttcctgtatttccatgccggccgccgtgcccttcatagggtcctggaacacccggccaatgtatttggcccgcttgtattcgggctgcctggatatattcacaccgtcaatctcgatctttccggaatcaatggggtacacgccggctatcatattgagcatggtagacttgcccgctccgtttcccccaatgaccgtcacaaaatccccgtcgttcagggtcaggtcaatgccgtttaatgccttcttctcattgatggtgcctttgttgaatgttttgcgcacattggtcatgatcagcattatacattccccccttccgagtattccttgtaggtcctccatttattggcagctaccgggatacagagagccagggtaaccacaatggcggataaaagcttcatataatttggattcatgcccatcttaatgacaaaggcccggatgacaaaatagatcacggagccgatgactgccgctgacagcttaagggcaaagttgcggaaccagccaaagagcacctccccgatgacaatggctgccagtccaataacaatggctccggtacccatctggatatccgcgtacttctgcccctggcacaccagggcgccggacatgcccaccagaccattgctgagcatcagagccagcagcttggtccacttggtattgacccccagagcgcggatcatgtcctcgttatttcctgttgccctcagggcgctgcctatctccgtgccgaagaaccagtacatcacgacaaccataagtatggctgccgcgatgccgatgacctgggacgcctgggcctggttaaagcctgtggcggaagaaaccatggtcacaatggacttggacttgagaaggggaatgttgctgcttcctcccataatccacaggttgatggaccacagggatatctgggtcagaattccggccagtatggaaggtatctcaaataccgtgtgaaggatgcctgtcacaaaacccgccgccattcccgccagggtggctatgaacagggctgccaccggattcattcccctgcccacaatcagcgtggcacagacgcagcctcccagtgcaaagcttccgtccacggtcaaatccgcaatgtccagaagcttgaaggtgatgtatacccccagcaccatgattccccagagcacgccctgtcccactgcatctaacagattggggcccatgccctgcatcagattcgcaaaattcatatcttatatttacctccctttccgtctctattcctttgtatcatttgataatgtaaatagcttgcccaaaccgctgttcccggaagccttacagcttgagcaaaccatctaccttctttaccggacgccattttatccgataaccgctattttgcccgatgaccgaaaagagggtgctgcaggccaaagcggttttcaccgtctctgccccgcagcaccgcctgtatcatcctgagctgcctggctgtctattttaatccggatacatcaatcccaagtgtctgggctgtttcctcgttcactgtcagctcgcacttctcagccggcaggtactcaatcggcatatcagccggtgacgctccctcggtgaggattttcacagcctgctggccggtcatatatcccagctggtaataatcaatgccgtatgtagccagtccgccgttctgcaccatgcctgcctcgccgcagataaccggcagattgttgtctcctgccaccattccaactgtggccatacctgctgcgattacattgtccgttggggcgtaaaccgcatccacggcacctaccatggactgtaccacggtctgaatctcattggaactggataccgtgtattccttgctctccatgcctgccgccgcaatggcttcctttgccatgtcagcctggatcttggagttggactctgcggagcagtacagcacgcccacggtcttggcttccggaaccagctgcttaagcagatcgatctgctccttcacaggagtcaggtcagaggttcctgtaacatttgctcccggcttttcattggtgtcaaccagaccggattcagccgggtctgtcactgcggtaatcaggacaggggtatcttccactgcgcccaccatggcctgggcagccggtgtggcgatggccagaatcaaatccttcttctcattggcgaacttggatgccactgtctggcaggctgactggtcgccggaagcattctgctggtcaacctcgtaagcgattccagcgtcgtctaaagcagcgataaaaccgtcattggcagcgtccagggcggtgtgctgcaccagctggagtacgccaatcttataggtggttccctctgcctttgcagcagtctcactctctgatgcctctgccccggttgtctcctccgcctttgaagccgtatcagctgctgtctcctgggacttggcggcagctgacgtggtttcagccgtattgcctgcgcaggccgtcatggacagaaccatggcgccggctaaaaccagggacatgatttttgatgtctttttcataatactatctcctctttccacataagaattcgtcccctataaggacgtttcctatcatactacaaaaaaattgcgccgtcaattttattactttaaatttctgtgattttaaagtaataaagtgaaaaactggtgttttttgcagatatttccattcttatttatgcatatcgagaggaatggtgacagtaaactctgttcccttgtctaactcagaggtcacatggatggttccatggtaaaaattcacgatgtgtttcacaatggacagccccagccccgtaccgccctgtttgcggctgcggcccttatccaccctgtagaaccgctcgaatatgcggtccaggctttcctttggaattcccacgccgttgtcctttacccttaccagcatgtcatctccctgttcacccaccgtaatccacacctgtcctccgggccggttgtacttgatggcattggtggccaggttggtaaacagctccttcatctgctgcaggttagcacggatacacaggggcttgcagtccacatggagaaacacctggcaggaggcagccagcggctttaggctgtccatgatctcctggagaagcacgctgattctcacatcggaaaacattacctcggcatccatggattccaggcgggatatcatcagaatgtcgttgataagccctgtcattccagcggcctccttcttgattctctttgcgaaatccagcttcaggccgtcatcctgaatcatgccgctctccagtaactccgcgtagccctggatggaggtgataggagtcttaagctcatgggacgcgttgctgaaaaattcctggcgaatctgcttttccttttcaatctggcttaaatattcctttacgtcctttgacatattcatgatggtctcggcaatgacgttgatttcaggatattggcagctttcaaactgcagctccgtgtaatccccctttaccttcatcacggctttcgagatatcgcgcaggggtctggtgaccgacgacacaaagcgtctggtggtcaccacggagcagaccatggccataaggaagcttaaaatggcggccggaaacagcatgggaaggtattcttgtatgccggaatagggcacggccaggcggagcaccatgtctgaatactcagagcggcaggccacatagagcatggtttttcccagtgttttggaatagcgtctggcatacccctccccctgctccatggctgcccgtatctcctcacgtccctggtggttgtccaggtactcggcgtccgcgtcagaatccgttacaacggttccatccgactttataagggtcaccctgctggaatcctggtccgtaaacgcctccaggcgctccatctgctccattaagtccctgtcgtaatccaggatgctgtccacggccttgatggtgtaggtcatatcatttttggagttttttaacatcattttgctgctggcaatataaaagatgacgctgttaatacacagcgccgccaaaagtaccaggataaaacgttccaataatgctttacgcatgtcttcctccttggtttcctgtcatgttatctcaccatacggtagcccacgccccggaccgtcttaatgcaggcaccgccctcttcccccagcttctggcgaagggtgcggatgtgcatgtcaagggttctggtctctccatcgtactcataaccccagatgcggttgagcagttcatccctggtcaccaccctggactggttctccagcagataaaccaacagctcaaattccttcagtgtaagctctaccagccggccgccgcttgacacctccctggtcttgcggttgacctggatgtcctggtagaacagcacatccctgtcctcctcccgtttggtcctgcgcagcaggctgcggatgcgggccgacagctccagaaccccaaaaggctttaccatgtaatcgtctgccccgcagtccagcccaaccaccttgtcaagctccttttccttggccgtcagaagcatgatgggcacatattttaactgctccgtatttcttacctccttgatggcctctgtgccgtccatccccggaagcatccagtcaaagattaccaggtccggcttttcttccttcatcctggccaggccctcctccgcggtttcaaacccttccgccgcatatccaaagccctccagggcaatttttaacagattcatgatgttttcatcatcctcaataatataaatccgttccattttccaactaccgcctttcccggcatacagcctatgtaaacagcataccagactgaagtaaaatccacctcatgggaatgtaaaacttgtgtaaagtttttcccgctacaggacgtccttatacacccggagcacatttttacagaatacagcttctatttccgaaggggtaaagccttccctttccatggcatgcgccagcatagggagctttcccgcatcccccatctccagattcccgctgattccgtcgaagtcggaacccagcccgatacagccgatgccgccaattttccgaatatgcttcatatgctccaccatgtcggatatgcggcttaactgctcttcccccggtccgaagtcccgcagaaaggcagtgcagtaattgatgcccatgacgccgccgcgttccgccagggcgcgtatcatatcatcggtcaggttcctcggatgggaagccatggcccttgcgttggaatggctggccacaaaaggttttctggtatgccggaacacatcccatatgcctgcgtcattcaggtgggaaatatcaatgatcattcccaggcgctccatctcctctacaaatgcaatcccggtatccgtaagtccgtgctctgtatccggcgccatcctgaaggtaccgtcctcctctgtcatcctggcattgggaaatgccagctcgttggggaaattccaggtcagggtcatcatgcgcacacccagccggtagaaatcccgcagaaacgccgttttaccctggcaggtcccgccttcctccactgtgagaagggccgacatcctgccctgctcccagtttctgctgatatcctcgtaggatcggacgattcctatgatatcctcatgggcttccatttcctggtagaaggtatccagaagttccatgcagaattcaaagggccttcccttggcctgttccagattgacatacagggcaaaattctgcagcccgtaatcccctgcctgcatctttttcaaatccagcatcatctggttctccaggatggactgcctgcctcccttcttatggtccttatagatttccgcaatggtatcgcagtgcatatccacaaccttcatatccctgtcctctttcctgttctttggtattcccaatttattcctgtataaccggaaatattctgtcacccgttactatgttccagtttatactgactgcctgtttctgtcaatcggctgcattggcctctgagaggatttcccctgcccggcagattgcatcgtcgatgcggggcgctatgttttcccttcctatctccttatcaaatcctgccttctccatcacagacaggggctgttcgtttacatgggaaagaatcatggttatacgggccttgcggcaccttgcgttcagcttcttaagactgttcagggcggttgcatccatggcgggaacgcttctcatccgcagaatcagcaccttcttgtctgaatccaggggaatctgtccaatcttgtccgccgcgccaaagaacatgggaccgttcacctcaaacaccataacctgtctgggcactggttttaagtcaatgcgctccctgtccgtgctctcctcgtaatcctctgcgtatttccatccgtaaatatcagacacatccgccatgcgcttcatgaacagcagacaggccagggccagtcccacgccgatggccatgaccagatcgaacaccactgtgagaaaaaaggtcagcaccagcacggccgtgtcacttttgggcgctgtcttcaccacatctgcaaaggaccgccactcactcatattgtaagccaccataaacaggatggccgctatggcaggcatgggaatcagagccgcatagggcattaggaataccagaatcagcagaagcaccgctgcgtggaccatgccggccaccgggctgcgccctccgttctttatgttggcagctgtccttgcgatggcgcctgtggccggaatgcctccgaaaagcgctgaggccgcgttgcccactccctgggccaccagctctgcgttggagttgtgctttccgcctatcattccgtcggccaccacacaggagagcagggattcaatggcagccagcacggctatggtaatggcgtccggcatcaccttctgtaccaggctgaagctgatattcggcagatggaacgcgggaaggccggaggaaatggtatacaaatcccctatggtattgaccctcaggcccattcccttaaccagcaccgcggcagccacaacggcaatcaatgaaggcggcaccttcttaaagaacctgggccacagaatgagaatggccagtgacacagctcccactgccagggcctgaaggttcagggtatccatgcaggagataacctggcccagcttctccatggtctccaccggtgattccctgaaggtaagtcccaggaaatccttgatctggccgataaaaatggtcactgcgataccggttgtaaagccggttgtaatggtatatggaataaaccggatcaggctgcccaggcgcagaaagcccataataacgagaataagaccggccagtatcgtagctgtggccagtccctccattccgtttttcatgacgattcctgccacaatggtggcaaaggctgccgtagggcctgctatctgcaccttgctgccgcctaagaaggaaataacaaacccggctatgatggccgtgtaaagtccctgttccggtgtcacaccggaggccagcgccagggctatggacaggggcagggctatgatagccacaatgattcccgatatcacgtcctttgtgaattgttcctttgtgtactgtttcatggacagaaacagctggggtgtaagcgttttcatctcatctttatccttttcgtgtttataaaatgttaatacttttttactatagcgaaaggatggccccatatcaattgttttccgtcatgtttccaatataatacaaaaagcagccgccggcacagattactcacttctcagggcgtctatgggatttaagttagccgcccggctggcaggcatgtatccgaacagcagtccgattccaacggatacgctgaaggatatgacaacagccgacagggtgggggtggcagacacgcccaccgctgctcccaccacagtggtggcgacgcagcccaccaggattccgatgatgccgcccagggagctggtcacagcggcctcaatgacaaactgccgcatgatggttcccttatccgctcccagggatttgcggattccgatttcccttgttctctctgtgacggataccagcatgatgttcataacgcccacaccggccaccagcagggagattcccgctattcctcccagcatgccgctcatcatggcaatctgctcgttcagggaatccagcatctcgctcatggccgtcacgcggtataaatcctcatccttaaaggtttcgtacaggaaattcttgatgactgcggtgcactcgtccgccttgctggtatccagcgccgtaaaggtatagttggtgatattggcgtttctggacatcttcacggctacgctgtatggaatccatacaaagtcatcggttcccccgtcctccatgttatccgcgtcctgggcctccgctacacctatgattttaaaagcgtagccgtctatcttaagggtccgccctatggcgttctgggagcttccgtaaagctcattggccacgtaagcgcctatcacgcacaccttctggcgggagacaatatccgaatacgctatgttcctgcctgtttccagttcataggacttgatttccagatattgttcactgcgccctgccactgacgtggatgtcatggagtcatccccatatttgatggtggaggacaatgtcacattggggctcagttccccgaacaggtctgtatgttcctcataaaaggcatacatctggtccacatccagggatcgggaagccagattggtcacatttacattgatctggttcacacccatgctggcgaagctctccaccacgctgcccatgtacccgttgaccagacttaccagtatgataaccgcggccactccgataataattcccagcatggtcaggaatgaacgcatcttgttgccccaaatgcttttaagggccagcttaaatgattgcagcatagtcttttacatctccgtcaaaattaatctgcccatcctttatccggaccacgcgtctggcttccatggcaatggcgttgtcatgggtaatcatcacgatggtgtttccctcgtcgttgagctgtttgagaaatcccagcacatcgcggctggtcttggaatccagggctcctgtaggttcgtccgccagtatcagtgaggggcttccggccagggccctggcaatggataccctctgctgctgtccgccggaaagctggttcggcatgttcttccatttttccgacaggcccaccttttccagggaagccatggcccgctcccggcgctctgcatttcccacaccagcgtacaggagaggcagctccacattttccagtatgttaagcttgggcagcaggttatactgctggaaaatgaagccaatcatcttattgcggatgcgggccagctgtttgtcatccatgatgcccacatcctcgcctcccaggagatattcgccgtccgtgggcacatccagggctccaataatgttcatgagggtggattttccgcttcccgacttgcctacgatggccacaaactctcccctgtctatcttcaggctgatgtcgtcgttggcccgcacctcttcccctcccagatagtatatcttatggatatgtctcagctcaataagtgtttccctctgactggtattgtccatgtgttcctggttcctctctgtcttacttccggacatactttaacggttctggcggcctccggagccgccccggttttgtccgcccatgtttccgcctccgcccggagggccgcccatgccgccgtccatcatcatcataaagctgctgctgtttttgctggattcagccacatagaccacgtctccttccgaaaggccgcttgtgatttccacgtatgtgtcgcttgccagtcctgtttccaccttcacagaccggaaaccggcaggcaccggcccctgctgctccgtcactgtgtcatccttcacatagacctggtttcccctcatcagggcatccacggggatggccagcacatcattggcctcctcaagagtaataactccgtccacattcatgccgggcagcaaatcccccatatcatccagggtaacagtcaccgggtaggtgctgacaccgttggaatatgtgctctccaggctgacgttggtcactgtgcctgagaatgtctgtccctcaaaggcgtctgctgatacctctaccttctggcccacctttactttcttgatgtccagctcgtctatggacatctcaaatgtcaggctggacaaatcgtagatggtggccagcaccgtggtgctggagctgtttttggtgatattgtctcccaccttgaaattcttggtgatgacctggccggagattggcgcctttatggtgtaattatcatagctgtcctgggtgctgtccagcttgttctgggccgattccacgctttcctccgccttgtccagggcgtccttgtagctctggatcagcttatccgccgacttgtctgtcatcttaaaaacaggggttccttttgtaacgtagtcccctacatttaccagcagggactccacctccacactggtggacaggtccgcattcatggtggtgtccaccgatgcctcgaacactccgtcctcactgcctatgaattccccgatctgggccgtggctcttaaggatgtggtcaggccgccgggattttgcacctgtatggtaaccacacgcaccagccgtccgcctgtgaggacggtttcctggttagcaactgccttgactgttcctgccacctgctctcctgtatccgtcagggtaacggctgccggcatcccggctcctatgatggctgcctccccggacaaaaaaggaattcttatttccatcacatcgtcgctgtaaacatcggccagcttggtgtttccgctcaccttgtcccccacgctgatatacagttccttgatatatcctgtgtcggtggctttgtaggtgtttccgctgtaatcactcagggcgtcattataatcttccagggcgtcttcataggaggactgggatctgctcagggaattcaccgagctggtcagctgggactccatgctggacttatcaatttcatagagcacctggtccttttccacctggtccccctcctcaaagccggcagataacacctcgccctccaccatggaagtgatgctgtaggtgtccttggccttaagggttcctgaggaagacagctctgaggaaatgtccctgcgctccgccgatgccgtattgtgggactgtgcctgggcagtggctgcctttgccttcatgcccctaaaggtcatggccgcggctgcggctgctcctattatcagcaggattaccaggggctttacccatttctttcttccctttctgccttttactgcctgtgccggggtgccgggtgctgtttccctcttatgtctgcccgtggagagcttaaaaaagcgcaggacgcctttcttcttttcttccataccgcacctcacccttaatattctatggcgtcaactgccgtatagctgctgccgctcttattgcataccattaccacctcatcccctacctctatgccgccgtagatggaaaaaaggtactgaagctccgaagaattcagattgatggtgagatatccgtcctcgtcaattccatcctctccaaagtccccgtccgaattgtcgtcatcaatctccagacggatggaggtgggcgtcatcacgtccgtggatttataataaatgttcttgacctcgccctttaacagcacataggcgttgtttccctccagatcatcgtcgtcccatcccctggtggtataggcccagatggttttggacttcacattatagtagacaacggcaaagcccgcatcctgctgggatgccttcactgcttccagtgtgctggctgttccgtttaaaaacacattggcattttccgatccaaagggcacggactggattacgctgaagcccttgcgcaccagtatggggcctttgcgctcgtcgtccaggatggtgatgggattgatttccccgtctgagttaagctcgcagtccagaacagccccgtatatttcgctgctgtcctttttctttgtctttaacaggttgtaaaacaggttcatgcagtctgtctggttcagcacttcctccggctggcggttcatctcctcgttcagctccagatagttgaacttggaaatgcgcgaggatgccaggtccccggtaaagtcctcgtccgaataccccagcatggtcagcgctgccttcacagcgtccttatatgtaatatactcctcaggcttaaagagccctcccaggaaaccggtcatccatccctgggaagccgcgatacggatatagacagcatccggatgggtacccggcacatccgcgaacacggacacgctggaagaaggcaggttttcccggtagctggaggcattcaccagcattctggcaaaatcccctctggtcacctgtcctgtgtaatccgtcacattcaggattccggtcaggttcaccacctgtctcctcatgtcaaaatttgcagacgatgtattggctgcggcagtcacaggcagagccgaggtcactgcagtaatggctgccagggaaccgcacacataacggcaggctgcaagtggtcttttcattgcttttgctcctctcaaatcaatcggtattatcttttattttttatactctatcacagtaatgtgttcattttgtgatatgcgcgcaaaaaaaacgcaaaaacagcctgtgaatacacggatgaattccgtttttccacaggcatatttttcagtttttctttctctcctattacatcaaaggggcaacaaggcgcataagacgtcccagcttctttcccatccagctgtaatttttacagtcctccatcgtgataagactgcatttcttaagggtctcctcaaaatcacgctccacgtcaaagaccaccggattgcggtaaatataggccgcgcattcaaaatgcaggtaaaggctgcggaaatccaggttaatggtgcccaccacagccttttcgtcgtcgctgacaaaaaccttggcgtggacaaagcccggcgtgtattcgtaaattttcacgccggctcttgtgagctccggataaaaggttctggccagcatgtaggcatactttttatccggaatatgcggcataataagctttacgtcaatcccgcgtttggcggcatagctcagggcattgaccatctcgtcgtccagaatcagatagggcgtcataatatggacgtagctcctggcctggttcagtatatccagataaacacgctctcccacctgctccctgtccatagggctgtccccatagggcaggacgaagccggaatggtctgtggactggggatgttcatagtctttggggaccgcgtacttcccgtaatcctccggctgcctctccgtcacattccacatctgcaggaacatcatggtaaagctctgtaccgcgtctcccttcagcatgatggccgtatccttccagtggccaaagcgcaccttgcggttgatgtactcgtccgccagatttacaccgccggtaaaggccgtatggccgtctataaccacaatcttcctgtgatccctgttattctgataggtggacagggttggctttataggcgaaaacatcttacagcggattccctttttctccagcaccctgggataatggtacggaagaagcatgaggcagcacatgccgtcatacataaccctgacctccacgccctcctttaccttctcctccagcaccttcaggatactgtcccacatgtatccccgctctacgataaaatattccatgaaaataaaatgccgggccgccttaagctccctcatgagagcctcaaacttgtcctcccccagcggaaagtattccacatgggtgttggcgtaggcgggatacccagcgtgatccttcatgtaatcaatcagatggctgcttctcctgctggcttccctgattcgctcctgtacttcccggtcctgattcaggtaagcagccgtgtcgcctatgttttttttcagacgccgggccataagctttgtctggaactgcatctgcacaaatatatacagcaggaccccgaacaccggaatcaccagaaccggtacaatccaggccatcttaaagctggaattaataggttcattgaaaatataaatgatgactgccgcgctcaaaaggatggatatggcgtatacaatgtgcatgtactcttccagccaccggaaggcgccaaacaggattcccacctgtatggccataaacagcaccacaaaggccgtccttccaaatataatccggaataatcccctcaatttcttcatcctgtcccttgtctcctctcatgtaacatatgatgtactttatcgtacagcttatcatatgggtttatacagcccaaaaatccctggtgaaaaaccggcatccgccgacctgattcaccagggtttattctctgtctttatatggctgttacagccttcggggcgcccgtgaagattctgctgtccaaatccgcaatggtgactttctctaaatatgcctggcagcactggttcagctcaccatagagctcgtccatgattcccgccatgcctgacgaaatgagacaggccatatgcggattgccgcttttccaggaggcagccacaaagggggtatccagagcctcagccaccatggacaggttcacgtccctgctgtcacggtggaacagataaccgccgtccacaccttcctttgttttcacaagatctgcctttttaagctttgccatgaccttacgtatcctggcagcattggtacagacattcgctgcaagaccttcgctggaaaacacagttcccttgtgattcaaaaaaaccagcgcatgcaccgcaatggtaaattcacttgtcacttttccaattcccctttcctatctgcaacagcctgctgctgtctttcattaaatcataccatttttttcagaaaaatgcacttattttttatttcataaaccaattcataagccagcctccaagccggctcatgtaccaaagggcattatggcctccccttctgcggcagcttcttctgtctgcccttcctggaggttttctcccccgtccgtctggggaagctcctgcgatggcggcagggcggctgaattgcgctgtatcttagcgggttttgctttataggtgctggtgtaaaggaaggtctcttcctccacctgtccattttttgtacggatgcggtaggacttccagaccgagcccggctgggcctgctccactatcttttcttccccataagccagttccgggttttcctcgtaaacaggcgccggcggttccagctccctgatcttttccgagcgcatggaaatgcgttcattctcttccagcaggggaaggcctacgatagaaagcttcagctgttttccgtcaaaggaagccctgaggccgatggaagtgttctgggtgttgacaaacttaaggtccgggcccgcatagccgtcaaagctcaccatggcgtcctggcccttatcaatataactgggcgcaaaactgtggaaattccgctccgttgtcttgtatcctgagttgataatggcatggtacagcgtggtggaaacctggcacacgccgccgcccggttcctctatgagaactccgttcctgtaggcgcctgcgggctggtatcccttttcgctggtgcggttgcctgtggccaggttaaaggagaattcctctcccggctttaacaccacgccgtctatggcgtctgccgccagccggatattctggttcctgttcttgttatccgtggtggtggtggaaaaagttccaatcactttgtactggtccctggcctgggcagcggtccgtttgggcgcgatggaatcaaagggcgcttctgtctctgtggtaaattcgccctttctgactgcctccatcagttcctccaccagctgctcctgcttcaggctgcgcccataccgttcctctgtatagcggtaggtcttagtctccttgtcaaaggattccatctgggaatccactgcccctctgtcccatccctgggccagctctgctgcctgctgcgcaaatgcctgctccatccggccataatccagttcatagctctggggcttatccttatccccgtgttctatggtttcaagtatcttctccagctgagggccggccaaatcttccagggaaacactctcttccccgtttctgatcctcatatcccagcggtatgtttccctgaccctggacacggcctgttccatggtaagtcctgacagatttaaggttcctacccgcacatctttcaggaattccgtctccaaagcctctggcatctgcgtgctgtccggtgtctctatactcacctgagtgcctttggcctcccgccctttttccctgattacggccgctgccccgtagacgatgacagcagcggccagagctgacaggatccatgccttttggaccgttacccttgtccttctttggtattttcttcttatcgctctggctctgcttctgttcatcttactatctccgttttccttccattgtctgttctataatgttcttcatcatatcctcgttcagctgaccgctggcataaccgaatacgttcccgtccctgtcaatcatgaatgtggtcgggtaggaataaatgccgtatgcgctgaacagctcgcccgttgtatccataagcaccggatatgtgtatccgttctcatccaggaattccttgattccttcttctgacttttcatttccatatcccggtcctgccactcccagtacgataagggcgtcatccccctctgtatcataggtctcatatattttctgtatatccggcatctctgcccggcagggaggacaccaggtggcccagaagttcaggaatatggtctttcccttgtaatctgacagggaatgtgtattgccgtactggtccttaagggtaaaatcaatggccggaagcacctcctgtgctcctgcttcggcctggtctgccccttcttccccgtccccggctgtttcctccggtgcattggccttatctgcttccgtagcttctgtctctgccccggattcgctgtcagcggactccggctcagtacctgccgtcatggccggagttttgtctccaccctctcccggctctttgctgccctggacggatgactgggtctggaatctggacagatatcctgtcactgcgttcatccttccggtaaacatcagaaggcccatgaatatcatcagaatgcctcccacctttaccgtgtattttaccacattgccatgggtcttaaagaattccagcaggctggtggtgaaaagtcccactgccaggaacggcagcacgaatcccagggtatagacccctatcaggccaaaggccaatgcctttgtgctggcagaggctgccatcagcaggacgctggccagagccggtcccacacagggcgtccacgcaaagctgaaggtaaatcccatgattaaggctgttattggcgacatggccagcatatccagcttaaaaggcagcctgtgctcctttcccatggctccgctcttaccaaaaaatcccagctgataaaatccaaagagcaccaccagaattcctcccactctggcaaagagaagctggttgctcttaaagaaggttcccaatgtggagaaccccagtcccaggaggaagaaggcaaagctgacgccgatgacgaaacagagggtgtgaagcattaccttgctccgctcatagtgcatacggccgtcctcaccgcgcttgccggttccgccggaaagatacccgatgtataagggtatgaggggcaggacgcagggggagaaaaagctgaccagtccctgtatgaataccgtcagagccggtacactgatatctaatgaaaatcccataggtgtgtctcctttttatgttttctgtgtgatgtttttcctgtggtttatatgtgcagcatggtatctttttctataatgctttttctataatgctttttctataatgccttttctgtcatgccttgttatcataccgcaaacaaatcattgaaggcctcgctcatagtgggatgggtgtagatcgtatccctcagcacctgatacggcacctttgcatccatggccagcttaatcatattaatcatctcataggattcctgacagaacaggtgggctcccaggataagtcctgtctcctcatcaatgactgcctttaacagtccggccggctgttccagtacctgagcctttggaatggccgatgccgccagcctggctaccttcaccttataccccttttccactgcctctttttcacttaagcccactctggagaaaggcggtatcaggaaaacgctgtaaggcactgcccctctcttcttcaatgtatagcttccatctcccaggacctttgactttacgattctaaagtcatccagggaaatgtatgtaaactgcagaccgcccctcacatcgcccatggcatagatatggggcgccgtggtagtgagggaatcgtctgtgacaatcccgcctcttggcccaatctccacaccggctgcttccagattaagtcctgctgtgttgggcctgcgtccggtggctaccagaacagcctcggcttccagcttttgaacttcctttccgttatccactgccaccagagctttgccctcggcctgctccagagccttgaccttgaccccggtcatgacacggatgcctctggactccagggactccctgacagctcctgcaatttcctcatcctccctgggaaggaatatatctccatcctgaagtatggtcacttttgagccaaaacttgcatagatggaagaaaattctactccgatgtaaccgccgccgataataaccagcctggaaggaagttcggtcaggttcagcaggccttcactggtataaacataaggattcccttttaatccctcaatgggcgggatgaaggcggatgagcctgtgttaatgaatatctgctctccttccacctggaaggtctttccgtctttctccacctccaccacatgagacgactggaaactggcggtaccgtcaattactgtaatattgggattgctgtccagcttctggtagttctttccccgaagcctggctgtaaggtcttccttctgttccatggcggctttataggcggcagccttctcctcaaaggaacctcccttggcagctgccagccctgccctatacaccagtgatttggtaggaatacatcccacattaatacaggtgccgccgtacatcctgtcagacttttcaataagggccacttttttgccggccgccccaagggctcccgccattgtctttccgcctttaccaaatccaattataactgcatcatattttgtcctgttctccatcatattctcctccatagggattctccttatctatatgtaatatcaattgttacagttcttactgtaactatacatgatacagttatctttgtcaagcattttatttcactattttccgggtactgttgcaggcaggacacatcctgacgaattttttaagagatcacaaaacagaggcagtccatatggtgttcgcagaatacaatatgaaaggtgcatttgtaactataaaaggagccgatccccctcacatctatgtgtaccgtaagcgggcggctccttttgccaatttcttaatcttctaacgcctggcggatatcctcaatcacgtcgtcggcagactccagtcccacgctgaagcgaatcatggatgggtccacacctgcctccaccagctgttcgtccgtgagctggcgatgggtatggctggccggatgaagaacagctgtcctggaatcagccacatgggtttcgatggagcacagcttcagcttatccatgaacacggaagctgcctgacgcccaccctttaaaccaaaggagataacgccgcaggtaccctttggcatgtatttctgagccagctcatagtacttatcccctggaagtcccggatattttacccaggccacatcttccctggactgaaggtaggaggccaccttaaaggcactctcacagtgtctcggcacccttaaatgaagggtttccaggccaatattaatcaggaatgcattctgaggagactggatggaacccaaatccctcataagctgggctgtggccttctggatataagccagcctgccaaatttctgggtatacacaatgccgtgatatgactcatccggctctgtcaggcccttaaatttgtcatgatgggcctcccagtcaaaatttccgctgtccacaatgcatccgcctactgtggccgcatggccgtccatatattttgtggtgctgtgcgtcacaatatctgcgccccactcaaagggacggcagttaatgggggttgcaaaggtattgtccacaatcagaggtacaccatggctgtgcgccagacgggcaaacttctcaaaatcaagtactgtcagggcaggattggcaatgctctctgcaaataccactttggtgttaggcctgaacgcctttgccagttccgcctcatccgcatccggattcaccagagtgcactccactcccatcttggggaaggtaacggtaaacaggttggtggaaccgccgtatatggtggaggagctgattacatggtctcccgcctggcagatattcaatatagcataaaaggtagctgcctgtcccgaagaagtgagcatggcccccaccccgccctccagctggcagatctttgatgccactgcgtcattggtggggttggccagcctggtataaaaataaccgttctcctccaggtcaaaaagccgtcccatctgctcactggtggtatatttaaaggtagtgctctggtatatgggaagctgtctgggctcgccgttcttcggctcccagcctccctgtatgcagattgtgtctaatgattgtttgctcatgtttcctgtgtcctccttatggtcaggttctaaatggtgatgagattatattccttattgccaaggcccagcttcacagcatggtcaatacaggtctcccagttggtatccgggtgcgtattgatgaaatggtcatggctgtgatgatcctgctccgccagaaaacttccggcaagcacgggctggctgtttaccgcgtccacacaggccatgtccagggctaccgggtcaaatgaagcaaacatacccacgttaggcacaatgggggcgtcattctccgaatgacagtcgcagttaggggatacgtccaccacaagactcacatggaaattcggacgtcccttcagcactgccagggtgtactcggcaatcttccggttcagtatatcattggcctcgtcgcacatggagtccaccgcatccacgggacaggctccgatacagcggccgcatccaacacacttgcttgtatcaatggaggctttgcgttcaaggaccgtgatggcgctgtgggcgcagtttctctgacaggcgccgcatccgatacatttatctgtatgtacaaagggcttaccggcattgtgcatctccatcttgccggccctggagccgcttcccatgcccaggttcttaagtgtgcctccaaaaccggttgcctcatgccccttaaagtgggtcagggaaatgacaatgtccgcgtccataatggcccggccaatctttgcctccttcacgtactctccgtcaatgggaaccagggcttcatccgttcccttgaggccgtcggcaataataatatgacatcctgtggtaaagggattatagccattctcataagcagcgtccaggtggtccaatgcattcttccttcttcccacataaagggtattgcagtcggtcaggaataccctgccgctttgggaccggattaaatccaccaggaccttggagtagttggcacgcaggtaagccaggtttcccggctcgccaaagtgaatcttgattgcagtgtatttgttgttaaagtcaatatccatcatgccggctttttttaccagcctctccagcttctgcaggagattttccgtaagtgtagtcctcatgttggtgtagtatacatttgatactgccatgatgtcctccttctaaatcattatcccgtttattatacttcaaaccctgcatttattcaatcctgtatgtggggacaagggcaccaaattttttcgggtgatcttttcccggattcttcgtacatgttttacctcggcgccacaatatcatcggcacaaacagaaaaaggcccctgcgttaaagcagggccttctgtacagcttcatcgtgccgtgatgatggaaccggttatattcctttcagctttttccggtaaatcagataggaatacacacttggaatcaggaccattgccatgaaaaccaggaagaacaggtatgccagatgaaagaatcccataatcagcatcagtatgccacctgctgtccatacataccccgccaggcggtgggtcctgttccagttatcctcatcagccagggtccacggaagtttaattcccatggtataattctgtttgcatttgggcaggtaattgcctgctgccacaaacatcaatgctatggggatgcttattacgcttcccacgtttatttccataccgatgccggacaggacaatcactaactggaccatcaccgccagcagcaccacaaaccagcgggtaatctgcttcagttccctggaacggctgatattttcgtgtttgggatcaatccggtaaataatattcaccaggactgccatgagaaacataaaggccggtatgccgaaagcagccatattgcggctggagtaaccatctgccacattgtcaaatccccagtgggtgggaacctgagccggcaggcggttataaaaacagatggaaatgataaagggcacaagggccgtaagccagtacattatatcccacttggagatcttcctgttattttttttcatgtttgtcttcctccattaatgaatgcatccaggaaagaacttcctgaaatacagtggtattaagctcataataaatatatttgcccgatttccggtcctctataagtcccgcctgcctgagtatgttcaggtgatgggaaatagttgctcctgttgtgtcaaaatgttccacaatctgtcctgcggtcatgcttccctgctttaacaggttaagtatctcgcgtcgggtggggtcggacagggctttgaatgtgtcaccgaaggacatggacaaaatccctcctttcgctttgcctgattttatgtatttttatcgtgaggtgggggcggctgtatgggcggctgcaaatccggcttctgctcatttagatatttatacgtttagacgtttatcaaaatatctaaatgtatagtaacaaatttttcaggatatgtcaagagggaggaaagcataatgcccgtaggacatcagtcccgggcatatgtctttcctcccaaataatcagcagcagccctgctgtcgtcttatttttccatttcaaccgccagcttcagattagccttctcatattcattgaacacgcctgtgtcaaaggaatctgcggggtattcccctgaataccaggtaaatgtgctgaaaaaatcattccagaaatcactcttgaaaatatatccatggcgggcataaatctcgttgcggaataccgctgtcagttccggtctccagctaatctgctccatttcctccatggaataatatctgtcatcggaatcaaatacaggagtaccatagtcatcaggcactgcccccgcaggatatatgcctgtgccgccttcctcaacctccattttgtaagccgatataacgtaatgcagggcttctgccgtaggggcttttgcatcctctttataggcgccatggtaatcccatatgatttcattggataaaaactgatatcccttggacacctgcttcagggttacaatgctttccagattaaactggctgtatccgtcggaaagacaccgtatcctgtatatcccgccatccttctcgccgctggggcagaaaaaacttcttatgttggtatcgccgtgttccgcataataccggtcatagggggccaggtaaatccacccaatccctgttttcatctgttccagcgtcagtccggttttctctgtgagaaactcgttcatctgctccgtacccagcctcaccaggtctgtgtaaagctccggctgtccaacggttttcaggtacacttccctttcttcctctgttaacggagactgttccaggccggctccggaataaaacacttcattcaggtttatatattccgggcttttgtagtctgacataagaaatccgtagttgtcgatccggttcagatatttttcaaaaccgcgcagctcctcttgcgtcaaaacccgccttggttcatcttcccaggattggtctgcgtcatgatccgggacagaggaactgtccggctccctgttgccttcctggctgccaaagctctccggctccgcattaccttcctggctgcccaagctgtccggtgcgctggtattatcctgcataccatcattctccgcgcctgccccggtattatttatatgactccctgtatctgcgcggcatgccgccagactcagcattgctgacaggataaccatggccagcacgccttttaggcatatggttatgatacgctgctttttaatccatttcatgaaacattgccctccttactgcctctgctctcatcttttttcccgaccgacgctgccttataggcccgctttgcctcatacatggattcgtctgcatgttttagcaggcaggctgtatcggtgccgtcctcaggataaaaggcgtatccgtccgaaaaacgcacttgtatgcgttctccgttatccagctccgccgtacatgtttccatggtttttctaagcccggcctcatattccatcaattggtttcgtgaactgcatttatataggaacagcgcaaactcgtccccgctgagacgggctgcaatgcagttattccagccgcagcctttgagcaggcccgcaatggctgtcagataacggtccccattttcatggccgtacttgtcattgacctgtttcaggttatccgcgtcggccatgagcatcatgccgtgctctaactgctccggctccctgagcagctgttccatatggcggtaaaatgcccttctgttgtacatgcctgtcaacagatcaatgtcccgctcccgctcaatctgcttcttttccataatatcatctgtcacatccgcaatcatgcccagcacactgttctcccgctcaaaggactccaggcgtatatagcgcaaatcagcgccttccagccggtagattctctcttcccgctccaccggacggcttctcagggtatccagcttttgctcgaataagcagtggtctgccagaagctcctctgcttcctggtccttaagcctgagtatgcctgccagacggctggtcgccatgacacgcttcatatcccggttatattcatatacgcctatgggaaccctgaccatctccagaatttttgatatcttgttggtggtatccaaaagactctctaccattttgttgatttggaagctcaattccctgaattccggcgtgctgtccacctctaccctggtgtccagatttcccctggttatttttgccagcttgttgtgtatggaggatattccttccagtatatagcggtccatgtctttggagataaaggtgatcatcagcagggacagtccgatgaggtatgctgccaccataagggtgcttctgtttacctcccggtacagtgaggcgctggtagtggacatacccagtataacggaattgctctttccaaagacacagtagctgtccttctggtttaacactgccctgactccccggctggtgacggacatctggtccgggtgaaggcctatatcctgtatttgttttcccaccagtgtttcatctgtggagcccagtatggtttcgctctcaggatctatggcgtatacggtggaatccttttctgatgtaaccagggagaatatgtaggacagctcggtcagcttcatggaatccaaaaccgttgtcggctctaagcctacctgtataatgccctttcggtcttcacgccagaccgccgcatactgcatcagctttccctctgctgtgttgggggttatgtcctggcacatctggagatcatagttctctaacattggcaggaaaaactgcatttgctggccggagttaaagttaaggccaaaatatttgggctcggatccggcgtatagattgccttttgtgtcaaataagtggaactcgtctacctgcagcaggcgggctatcttttccatttcctgctggtctcccgtaacctggggacggtcctgcaggatgtaggcgattgctttggcccggataaaacattgctctttcaggttttctctttctttttctgcctctttttcgttttggtccagtatctggcctacctgccagaacatttcctgggctctggtatacatttcgttttgggcattatggatttctatgtaatagttgatgaggagggtagtcagcatggctgtcaggattacgatgcatagccgcttgcggataatctgcttcatttgggggagccctccttttctttggatggttgggatttgggggtggtggatgaggggtgggtaggtgatggggtgggtgggtgatagtgctctgagttataggatagcatattttgggtggggggacaagaggggacgggggttgggttgggtgataattattttatgggggtggagaatggggtggaatggaatggggtgggctgcctggccgggggccagggacgcttgggggcggtattaggtatgggagggagcggatccgccgggcggcagccctggaaacgcctcggcgttcccagggctgtggggcgttcgccccataaaaagccagataaaaaaccaggggggaagagataatgcattcttcccccctggttttttgtccggctttttgcccggctcattgctatagcattttttgcatctcgtctgctacaaactgtactttggttcctactattacctgtacagatgtcttgctgggcctcatgactccggctacgcctgcggattttatctttttctcgtctactaatgtgtagtcttttatctctaatctcagccttgtaatgcagttgtctaatgttactacatttcctttgccgcctaatccttctaatataatggctgctaccttggtgaaatcgtcgtttgctaatacagctgtcatttctgcgtctaaatcttctttctcacgtcctggtgttggaaggtcgaatttggtgatgacggcgcggaatactacgtagtagataactgcgaatacaacaccctgtactaacagcataaacggctggttggccattggaagcctgcagctgaagatgaagtccgttacacctgcgctgaagcagaagcctgcggtccagtggaatgcggctgctactgctacggaaataccggtcaggacggcgtgtacaaggtacagtccgggagccaggaacatgaaggagaattccagaggctcggtaacgcctgatacgaaggatgctactgctcctgcaatcaggatacctgccgcatactgcttcttctccggctttgctgtctggtacattgcaaatgcagctgccggaaggccgaacatcattacagggaagaaacctgcctggtacataccggtaacacctttgattccgccttctgcaaagccccagaatttgttgatatcggcaattcctgcaatgtcaaaccagaatactgcattcagtgcatgatgcagtccggtcggaatcagaagacggtttgcaaatgcatagagacctgcgcctacaggaccaagtcccatgatatgctcgccaacccatacaagggcgttgaacagcatcggccatacaaagtacaggatggcggactctgcaaccattacgaaggatgtaacgatgggcacacagcgctttcctgagaagaaagcaagcgcggtgggcagctgcgcgctgctgaacttgttgtaacaaacggacgctgtgataccggaaatgataccgataaacgcgttgtcaatcttggagaaggccagaggagcttcttctgcgcccatcatagtggcaacaactccgctgttaagtactgtggtgacagtcaggaatgcaaccagacctgcaagacctgccgcaccgtgctggtcctttgataaaccgattgccacaccgactgcaaacagcatgggcagcttgtcgattacggcactgccaatcttcaccagcgcaaaaccaataatctggatgataccggttacgtcaccgccctgcatggtggcaggacacatggcatagccaatacccatcataatagctgcaaccggcagaacggcaacaggaagcatgatggccttacctagtttctgcaaatacttcatcataacataaatcccctttcttttttagagcctccttctacacttttcccgtaggagtactctgaattacattttgataaatactctattcaaacctgtctccaggcttaaatcactgttacggtttccaggacagcttccacttctttcatggccgcctcctcatcgggtccgtcgatgcggaagatgacctcatcacctgctgtggtgttcatggccatgatgctcatgacatcctttccgtccgccctgcggtccccgcagataatttccacggaggagcttacatgaagcatcctgaccataagcatggcggccggccttgcgtgaagccccatttcgtcttttaagataaagctccgctctatcaactcatccccacctttattccttacagtttgatgatggctgtctctccggcctttacttccattccgttcacacattccatcttcgggaactggggcgtgttgcagataataaccggtgtagtcacatcatagccagcttccttaatcttatctatgtcaaagtctaaaaggaggtcgccctgctttaccttatcccctgctgccacatgagcatcaaagtactgccccttaagctgtaccgtgtccagtccgatgtggataatcagctccgcgccgttgtctgtctgcatgctgatggcatgctttgtgtcaaataccatggtcaccagtccgtctgccggcgcaaccaccctgccgtccgacggtatgactgctgtcccctttcccagaatctcctggctgaaggtggggtcgcttacctggctcatgggaatggctgttccattgaccggcgctgcgattatcttctcttccttttcttctcccccgaataacttcttaagtgatccaaacatccttgctgctctcctttcacgtcccacaagggacctgtcaaaataattacttagtcctgatacgtttaatgtgcagggccaggtaagccacttcttcctctgttacctggtgcctgtactgcagcttgatgagcgcctgtattttctggctgcaggcatattcctccggatacagacggtcaatgacctcctggaactccaggttatccagattcatatgctcccctgtaaatacccgctgggccagaaagcgcagatgagtgatgaacctctcatagctgagggactgctcatccagctctatactaaaatactccctgaccacctccaatacctgctgtatcagattggtgatcttaattgtatcacccataggtgcatcatactccgcattgacgatgtgaagggcaatggaagctgcctcgtccaccgggagctttactcccagatccctttcaatcatggcaatggcatattcgccaatgagatattccgcgtggtaaaagctgcgtacctccctgattaagggattggaaaacatcatcttctgtttgtaccgctccagtgcaaagtttatatgatccgtaagggtgatatacacatttgggttaataggccggttaagaacctctttggcataaccgatgatttctgccgatatctgtacatgctccatgggaaggttctccagcagttccttgaacttatccatggtgttctgactctccaggcggaatatcttctccaccttttcctcgtcaatggtactgccttcctttgctttgaagccaacgcctcttcccatgacgatgatctccctgccctcttcatcgcaggtgctcactacattattattgattattttcgctattttcataattgctcctgatgaaaacaaaaaaaccaactttgttaaagagacccatgtgcgcatacgcacgggtacacatcatccccttaacaaacttggttttgcctgccgaacagtaacaatccttattaattatttaattataacttccaaagatttacttcactaacagcatcatagcaaatcttaagataaaagtcaacaatattttatataatttttatatttgcccccactcctgttgtcagaattcccaacacagcccttgtcatgacttgacatacatgtaaataatacctgtaacagccagataaaaccaggtggcaggattggaaaaccaggtggtgaaaaatgacagcatcatatacatggcaatctgggcatagatcacatggcctgccggacaagacatcttccgcctgcgccttaccagaaagtaacatgcagctcccaggagcgcgcccaaaagcaccattccgaaaatgccgaaatcatagtaggcatcatagaacagggtaagggtggtcagctccttctttgtcacaaagagaggaaagctcaccaggaccgggaacaggaatttaagccccgtaagagcccacaccggaaacagcatgcgaagcccaaagctgtgggattccagctgctccaccagacagttaaaattatcatagttattggcaatatacatatagggctgtgtgatgaatatcggcatatggctgttcttcatctcaaaaatgccgttcaggtattccacgctgtggctgcgcataacagttaagagcagataggccggaatcatacaggccatcagcacgcccacatagaccaggctgaaggtgccgctcatggaaatataggtaaatgcggccatgcccacggccagaatcagctggaacctggacacgcaaagcaccggcacggccagggacagcaccaccataagcagtcccagccagaatccctgatctctggtcagtcctcttcccctgcgggatatcataagactgtacaccacgaacagactgggcaccagcacgcaggaaaccgtaaaataatggacaccgctgacatggaaataggaataggcatggggcacaccgtatgagaacagcggcacaaagcccagcttccacgcctcaaagaaaaaagcgaggaaggatatgaccaccagcgctgccatggaatgaagcagccgctttgcctgcagcggagattcagccgaggcgtaaaaacggtatacggactgcatgtccgccgcgctccatccatcatatatcctgtgcagcacctcaaacacaatccagaaggcgagcacggccagtcccaggcagacccatgtccggaggtcccaatccgtctgaaggcggctgagcttaaagcaggatattccctgcccgcccacaaaaaagaggcagaaaagcccccgcaggtgaatcaggttgcccgtctccctgtaatcctttatatacagccacaaggctgctgtaattaaaaccagcccagacagcatataaaaatgctgccgggccaatatgaagcttatgatataacaaaccagataaactgccattaatctgtaaccttctccacaaaatctctcatgtattgttctgtttctgctgtggtggcaaagctcatagccttgtcagccactgcctgaagctcctccacactgtactgggtaaccatcttcctggctttcagaatggcggatgcgctcatgctgaattcattgagtccaaatgccagaagcagcggaatcatcatcgggtcgcttgcagcctcgccgcacatgcctaccataatgcccgcctcacggccgcaggcaataatatgcttaatacttctgagcacagccggattaaaggtggaataaagataggatacctttttattgcccctgtcaacagacatggtatactgggtcaaatcattggttccgatgctgaagaagtccgcttcctttgcaaaaatatctgcaatcagggaagctgccgctgtctccaccataatgcccacctggatgtccttgttgtatgcaatacccttttcatccagctctttcttgatttcctccacaagcgcctttgcctggcggtactcttcaatgcatgttactaacggaaccataatacggatgttgccgaatgcgcttgcccttaaaagcgccctcagctgcggcttgtacacatcctccctgcggtccaggcagaaacggattgcccggtagcccagaaacggattctcgtccttctccaagcccatgtacggaatctccttgtcgcctccgatatccagggtgcggatgataaccggctttccgttcatggcggcagccacctttttatatgcctcgaactgctcttcctctgtaggcatggcgttcctgtccataaacaaaaattcggtgcggaacagtccgatgccctctccgtcatactggagcaccttgtccacgtcctcgggctttccaatgttagccacgatttccacctgcacgccgtcctttgtgacagaaggcttgccgatatactgctccagctccttcttttccgccagaaactgctttctcttctcctcgtaatcagccgtcacagcctggtccgggttcacatacacttcgccggtgctgccgtccagtaccacctggtccccgtccttgacgccgtccataaagccggtgacagccaccacagccggaatctccagtgctcttgccaggatcgcgctgtgggaggtcttgccgcccagctccgtgacaataccggttacattggcgggattgattcccgctgtcatggacggggtcagatcctttgccactatgatgctgccttcgggcagggaggagatgtccacagactggattcccataagcatctgctgcatacgggtcttgatgtcgcgcatgtccgtggctctctgctgcatcagctcgtctcccatggaggcaaacatatccgcatacatgttgcacacattctcaatggcgtattcactgtttacgccgtcattcctgacagagttctcaatctctcctgtcagcatggggtctgccagaagcatcatatgtccctgcatgatttccgcttccttctctcccaccctggttgccaggtcctctgccagtttctctgtggccttgatggtctcgtccagcgctcccttaaaacgctgcacctcctcttccacattgtttaccgcctgcctggtaataaccagctgtgcttcctccacaatcactgcttttccaattccaattcctgcagaagcgcttgttcccttgtacatcttcttgtacctccttattaaaaattcatttatactcacaacctttggttgccgtcaatctactcgcctaacccggcctccacgataccaaccatggcttccagtgcttccatctcatctggcccctcacagacgaattcaatctcgtctccagatttcacgcaagccccaaggacgcttaatacactcttggcattggccgtggtggtgcgcaccttgaaggatatttttgatttataacgcagtgcctccttgcagaggactcccgccggacgcagatgcagaccggacggattcttgattacagttgttttgcttaccatgatacctctctccttgctttttgttactgaccgggctctgccttggacgtgccggcaggaccttctgatgtctcactttctgtcccttcctggctctcatttgtgctggccgcagtactgtcagccgacggccctttttctgtcaccgtcacctggatacggtcgtagctcaccagttcataggcatcgcccagctggaacgtaatctccccgctgttctctcccggaaccatatcctccacatccatctcagcgcccagagcggcagacgaaagctggtccaaatcttccttcaggcctcttatgaccacattcacagaatccctgtcatactggtattcataatcgctgtggtatcccacccgcttaatctggcttgtcttaagctcaaatgtcctgctctccaaagcctccaccttgatgacaaccttcacctctttggatgactcgtccgaaaggtacactccctccggcagatactggctgatatccagggtaacttccttatcccctgtggctccgtccatattcagctcagagcttgggatggtaatggaattaatattggccaaatcggacttcagaccattgacagccacagaaggacggctgctctcaatccccgtataccggtatccgtccgccaccctgccctccggctcaaagttcagcaccaggctcttgcgcttgagaatcggcatagtataatccacactggagcggctgaatgtgatgcgctcgtcagtgggtatttcattttcattggcgtcaaagcacaccacaggagcgctgtctgacaggttggaatcagcgccgtccacattgatcacaattcccaccgcgctgatctgccccaccacggacatgggaccgctgacatttatataattcggtgaaacagaaggtgttcctttatcgtatccttcggcagcttcccctatgaccttggccctgatctcaaaggacttgcgctgcagatcctctgtcttgacgcggatgactcccggctttgccaccggagtgtccaaaagacgtctgttgttcttaacttctatcttcaccggcactgcacccgtaggttcatatatatcggccaaatctatataggccctgaaatccgaggcgctgatgcctgccttatccagtgtccttacacggtagctgacggtaacagtatccttatccgtcagcagctcatatgtcttgccgttggatgtcagaattccttcgttgacaatatctaacggcacctcctttgaatctgagtcctccgggttattgatattcaccactgccagccaaacaaaaaatgccaggaagacagaaagtactttaagcccaatattgttagacagctttttttccattcttcagccttcccttccatattttcaatcggttcaatgaaacagtctcctctttcacattggaaagtacctttttgaggctttctgcatctggtatcctggacagcactcctccttctgctaccgatacccttccggtttcctccgacaccacgatggtaatactgtccgtggattcacttacacccacagccgccctgtggcgcgtgcccaggtccttgctgatgctcatgttatcagtcagcggcagataacaggtggccgctgtaatgcggttgcctctgataaccactgccccgtcgtgaagaggtgtgttgtgttcaaaaatattaatcagcagctggctggtgaccaggccgttgatttcgattcccgtcctctctatctccttaagggaagaaccacgctcaatcaccatcagggcgcctgtctttaccttggccatctcaaaggtggcccgtaccagctcgttgatggtcttgtcgttaaagccctggttatccttgccctcgtcaaaggaaaagagataggacatgtaattgcggcttcccagctgctccagagcttttcgaagctcaggctggaatataaccaaaagggccgtcaccgcaatggtcgtggtattctccagaatccacaatatggtggtcagatgaagcacggcggcaaacagcacaaacaccaggataaccagaagtccttttaacaggttccaggccctggtgttcttaatccacaccagaagttcatagaccagaaaggaaataatcacgatttccagaatattccccactgatatccttggcagcagcgacagccaggatgtcacttttaccagtatttccgccatactctcacctccttacgttcactttttttcattaataagaatttctctcccttgtgccgcgtttatgggtactgattttctgtaccttcacatccggggtgctcacggtcatcttgggcaccgccttcacataataataataatcatcgtcctcgaactgcacatattcggtccgggtataatccacagacaggacaaaaaaattgaacacagccgctatggctgccgataaaacaagtcccagaatcatctgtcccacgggaacagatacaccaaacacaaaatctcccacaaatatagccagaagctccgccacggctcctgccacaatggcaaccacccatgcgtaatccatggacagcctgcgtatgagatacaccacgatgatacccaccgcgcaggtggcaatcatgaccatcatggtctggttaaagagcacggatttaagaatctggctgtatttctgtacaatatccacagagccgtcactggcagccaggatgcccgcattctgcttcacatatatgagcaggtaatacaggaacacgccgcatccgacgggaatcacggatgccaggcttcctcccagtccaaccagcaaaggaaccacataggggatcttaaacaggaaggcaagaggtgtcagaaccatcagataactgtccccgggcttgaatccgtagtagagaatggcaatggtcagtatgagcacaatggcaatcagggccatctccagtgaaaccgcatatacatgggcaatcatcaggcagcccgccaggaacacgatggcgccgtaaggcaggaacgcgctgaccagacagaccggaagaataaccaggggacttttaagttttgccatatacccgatattcgtattaaggcttaccatggtgcagagcgcaaacaggaagcgcaccaccggctgtattccgtaactgtagcggttgtaaaatcgtttcagatgttctttccatagcagaagacttgtcatcgaacccttcctcctctgttgtccttggtcctgtcggtcctgtctttgttgtcgtacttcttgaccaggtgtctcagtctggaggcatacatggtctgggaacgggacgcgtagtcgtaccttctggaatatactatccaggtcacaaacaggtaaaataccagtccccccacataaaggatgccccagttcctgccgcacttaagcagttcttctatgctcatgccgcccaacagcacgtccagtttgtagaggacccacaaaagcagcatcagcaggtagcagaaggtataaccgaaaaaggagcggaacatctgtccgccgacataatcttttttaaaataacggttaatgggaaatatcttcctgccctcattcttttcaaatatggccagcccagtcatatatctgaccttttcttcgttcagcatacaggtacctcttaggctttttcataacatatcaatttagtataccacaactttttcagatttgcgacactataaatcaatttttatgattttgtaaggaactggaatttggcttaagaaaccgccctattttcccaccagcaccaccacggttctgggacgaatcctgaatccgtctgcccccaggggacccggacaaggcgtatcctcccaggtgtctgccgccagctcccattccattccgtccggaagtacaggcagctccacatcaagctcctcccaatatgcattggacgcaatgtacacggtctgagggccttttccctcctcccggcccgcaaacatgacgcccacatatcgctcgtactccgcaaaggagctgcaccagggctttactccgtgaaagctcacatccgggaaaccgcaggccccgccgctcacattggcgcgcaccaggcggtgggtcttgcgaaaccgtatcatatattggaagaaacgaaatatatccttatacttccccagccgtccccagtccagccatgaaatctcattgtcctggcaataggcattattattgccaaactgggtgttgcagaactcatctcccgccagaaacatagggattcccctgctgcacataaggagggcgcaggcgtttcgcaccatgcgccgcctcagggcttccaccccgggatcgtctgtttccccctctgtgccgcagttccagctgttgttgtcattggcgccgtccgtgttgttccatccgtttgattcgttgtgctttacattgtaggaaaacaggtcgtaaagggtaaaaccgtcatggcaggtaatgaaattcacggatgcgttcttcctgtcatggtccgcatatatatctctggagccggcgattcgcagggcagccgcctgcgccatgccctggtcccccttgatatggcggcgcatatcgtccctgtacctgccgttccactctgcccagcggttccaggacgggaaggtccccacctgataaagaccgtccgcatcccacgcctcggctatgagcttgacatcgcccagaatggggtcaaaggcaagactctgaagcaggggcggcttgctcatgggcgtgccgtcctcgttgcgcctcatgatggaggccagatcaaagcggaacccgtcaatccggtacgccgtaacccaatagcgcaggcagttgagaatcatctgctggacaatgggatgattgcagtttaatgtattgccgcagccgctgaaattgtagtagtatccctcaggagtcagcagataatatatattattgtcaaatcctttaaatgaaaagaagggcccgttttcattcccttccgccgtatggttgaataccacatccagatagacctctatcccgtgctggttgaacacccgtatcaggtttttaagttcattgccctcccggttgtactctgtaccggccgcgtagctggtattgggcgaaaaaaagcttacggtgttgtatccccagtaattataaagcttacggccgtccacctcccggtaatcctgcatctcgtcgaattcaaatatgggcatcagctccaccacgttcacacccagctccagcagataaggaagcttttccaccaatccctcaaaggttcccggatgaagtacggctgaggatccgtgcatggtaaatccccttacatgaagttcataaatgattaaatcctccatgggtgtcaggggctgggccatatccgcccagtcaaagtcatccctgaccaccctggccttatagtgctggcatcccggcagcggttccccccaccggctctgtccggtaaccgccttggcataggggtccagcagatacctggtcttatcaaatataagccctttttccggttcatatgggccgtccacccggtacgcatactcaaattcaccgatatccagccggaacacaatcatggagtacacattgccgatgcggtaatgctttggaaagggcaggaccgcataaggctcctcctctgtccgccgaaacagcaaaagctcaatatctgtggctccatgggaatacactgtaaagttgactcccccgggtatggcggtagctccgttgatctcatagaatcccggcctgaccgcgtatcctcccacgtaatccatgggtaccaggtgaatggtgccgggcagggccagatggtcgatacagtttgttttttgatcccatgttatgccgtctgcggggccggcagctttctttcccttatcctccatacattcctcctatatgcgcccttgtgaggctgtttcaggcattgtattaacaatatacaacatcccagggcatattacaagacttggaaaaagccgccggacccaaactggtccggcggctttttccttctgtctgttttcacgctgacagctcatcttattttatttctgatatctctcccactttatcttttccatgggcagctcatccaattgatgggcaggcgcctctgcatccggcattccaagggtaaggatggcttccagcttataattttcaggaaagcccaggcgttcccttacaaattcctccgtggttttctcatccgcgttcctgagtctgccctggacccagcagctgccgatccccaggctggatgccatcagatgcatgtttgccatggcaacggaacaatcctcaatccacacgtcctgctcggtttcgtcgcctatgacaacgatagcgcactgtgcttccttcagcattttcacgcctcctgccctgcatccggagagatcatccaaggtctttctctggcgcaccacgataaactcccacgggcgttttgcctttcccgacgccgacaaaaggccggcctgaagcactttcgtaagactttcctccggaatctcctcaccgctgtagttcctgatgctgcgccttcttctcataatctctaataaatccatggtcttcttcctttctgctgctgcatccatatgatgccggcttacagtttcagatacgcttccagcacatccttcatatcgcaggtcataccgtaatccgcgatattaaagatcggcgcgctttcatcctggttgattgccacaaagagcttggtatccttaatgccctccgtgtgctggatggcgccggatacacccagggaaatgcatacctttggccgtatcgtaaacccggtctgtccaatctgatgctcaaagggtataaatccggtgtctgccagaggtctggtgcctccgattgctgcttccagcttttcagcaaaggcttttaagagtgtaaagttttcctcgctctcagcgccgcgtccgcccactaccaccacctctgccgcaaggatactgtccgtatcattcattgcaggggcgcttgacatcacctgaatccctgattcaggaagggtgatatctttgtaatatgtgacatctgcccttctgccctcctgggcctcacagggggtgtacacacccggccttaccgtcatcatctggggataaaccccttcctttgtcacgatggtgacaaatacgttttccccaaaagaaggtttgttctgcttgatgaaaaaggtcccgtcctccctggtatccacggctaattccgtacagtccgcagtcattccacagccaaggcgggcagccactctggaaaaaacggagcggcccgtgggggtagccggaatcagaacactggacgggtctatgcgcttcagcatttccgccattgcctggcttaccgcatcgtcctggaacaggcagttcctgtctgtctcaacggcatatatctcgtcaaacccaagctgttccagctgggccaccaaagccttgcagtcctcagccaggacagcggcctgtatcttttcaccggtggtctctttgatacaatgagctgcgcggaccagttctgccacaacgggttctaagttcccattataattttctgcaaaaacacaaattccgttcgccatctattcctttcctttctcaatctcaatcagttccttgagcttggctgccagttcctccggagtacctgaaagcatctgggctctcctggtactctcaggctgaaatgaatccgtcaccattgtgggagatcccggaagtccaatctcgtccgccgccatcttaaggtctgcattggtatatacctccaggggcttgttcttggcagctctcttggaacgcagggtcgccagacgcggttcattgcttccgaagcacacgctcaccagcgcgggcagggccgccttaatcttccactccataccctggtactttttcacagccgtaatacagtccttgtcatcctcatcatatgagagtccctgtatttcagccacatgggggatgcccatgtattccgccaccatagctcccacctgtccggtggcgccgtcagcagacaatgcgccgcttaaaatcaggtcgaatttcccgtatttctcaatgcttcttgccagcaccttggctgtggcaatggtatctcctccggcaaggcaccggtctgtgatgagacagctctcatcacagcccagggccatagcgtcccttaatgctttctccgcgtcagtggggcccatggtgaacacggccaccttaccgccggtctgctcctttaagaccatggcggcctctatggcgttcaggtccgcaggattgatcatgccttctgaactggaacggatcagggcatgggtttctgggtcaacggaaacatcgttggaaacaggaacctgttttataagaaccgctatatccatattttctcctctccgccgctttcttattttaacagacgctcaaacgcccagtcttccaataaaggtgtcttttctccgcgcataatgaattttgcaaggtctctgctggcggcaggtgcctcgataacgccgttcccgccgtaaccggttgccaggatatagccctccaccggtgtctctcccagaatcggaaggaaatcctttggctccgcacggtatgaaagccaggatgataccagtccgctgtccacgattcccggtaccctgcactctaactgatctaacaggaagtcaatgaagtaatcatcggttccgcctgtggccggaagtttgtccggatcccactggcctgcgtgcataggattgcttaaatccatggaaaggtgggacttgcagataaagatgttgtctcctgcgcgcagggcgtagaaggccgggtatttaagcaccgggaaggtatagcctaatttcttgcctggagggcataagaagaaggcttctgcctttgtatgccagatcggcacgtccatgcctaccatctcgccggtaaatttgctccatgggccggtacagtccacaacatagtcaaattcataatcctggccgtcgtctgtcttaaggccttttattttattgccctctttcagaacttccgtcacctttacgccggtcttgataacgccgccgtttttctgcatcttctttgcgtaggtgttggagatcatggttccgtcaaagtatccgtcatcctgtgtgtagcctgcgcccagaatattgtctgtggagatgtcaggaaggatttccttgattctgtccttgtccgttatgtactcgcctgtatagccggctgcctttgccagggcgatgcctgtcttaatggtggcctctaccttctcatctgttgcgaccaccagagtacctgttttatcaaatccggcggaacccttttcctctgcttccatctttaaatatgactcaaagccatacagccttacgtcccagtatctgtttcttaaggaatcgtcaaagagacatacggttccagcggactttgctgtggaagctccgccgatggtatccttctcaaacacaattacctctgcattgtcataaagactcagatgatatccgagacatgttcccgaaatacctccgccaataataccaattcttttcttttccataactttacctgcctttcacatttttatttttttatcacaaggtttatatatcatctacacgaaggactgtttccagcagcaccctgcacccctgtccgatatcccgtccctctgtaaattcatatctggaatggctgattccccccacgcttggcacaaatatcatgcctgtgggaaaaactgttgtcatgagcagtgaatcgtggaaggccccgcttgggactttcgtgtaaggaatatccagttctttgacagaggcttcaatggcatccttcacccattcggtcatgggcgccggctcatggtaggagaaccggttaaagctgtattcttcccccatcgcctcacagatttccccaaggcactctctcagcttctgttctatggtttccatcactttctcatcctggtcgcgtatctccaggtggaagaaagcctccccaggaatcacattcactgagttgggcaccaccttcatggttcccacggttgccactgtaaacggattaccgtaagcagctacgatttccggaacccgggccacgaatctggccgcagccaccagcgcatcctttctgtcctccatcaccgtgctaccggcatggttggcctctcccgtaatcttgatttcaaaccggctcactcctgcaatggatgtcaccacacctacgggaatctgcttcttgtgaagggacgccccctgttccacatgcagttccaggaaacagtgcacagagtctttggaccgtctggcattgcccaggtcagccacctttaatccgcaggccttaagcacatcccctctggcctgtccgtacatatccaggtcctcctcgctgacatgaaggtcctgtccgcacatggctccgcttcccaacattccgcttccgaaccggaagccctcctcatccgtaaataccacaatctccagcggatggcgcagctttctgccgctctcaatcagtgtctggcagacctccaggccggctacgcagcccagcgccccgtcataccttccgccgtccggcaccgtgtccagatgggagcctgtcatgatggcaggcagtgttttatcctctccctccagtctggcaatcaggtttccggcagcatccatcttaggttctattcccagcttccggaaatagtccatgaagatctcccgtcccttcctgtcctccggcgaatatgccatgcgggtgaatgttccgtcttcctgggctccgcattggtacagctcttccagccgtccgagaaccctgtctaaattgatatccatttaacccctcctcgcttctattcgttgtcaatcttgcacacaccgtttatttctttcctgaacttcttatctatattgcacattatagataatattttaacagattgcatcggagcaaactgataaaaatggagagataatttatctagtctggataaactatctctctatggtatattacaggctgaattctcacagccgcaaccccctgctgctatataaaatccttgttgtaattctctatcatcttatacaccaccagtccaatccgcaccgccagcacctcgttggcattgtcaaaatcaatcccggtcagcttctctattttttcaatgcggtaaaccgctgtcttatagtgaacataaagatcctgggccgttttggacaggttcagattccggtccagatacgccctcagggtcgtaatcaggtcatccctctggggtttcttatagttataaagcttctgaagcccttccggcacatactccaacagcatggaagggtcgcttaactggcacagcagcttaaatatgcccaggtccgcaaacagcataatctgggggcctccgtcctccggcgtctctcccgccacatccacgaacatgaacgcctcgttggcttctttaaagctctccggaagatttatgatgccgtccaccactctgcctgctcccgctttgattttaagatacttgttatatctggccacgtccgcctgaacctgttccgctatctttttgatgtttttgcgatattcctcctgggtctgctccctttccacctcctgtatcaccacgattttatcgagatcgttatggattttggctttggatatacggcttcggattaaatcgcttaagacatcaatatcttttacctttgccttaaagtctcccctggccatgctttcgtttgtcatgccgaacacaattacacggtagctgccgttgatgtcgacccccagcaggctggtattcttctggagttctcccatggaatggatttttccattgagaatattgtgtataatatcattctggaacttcttctccagctccgtcaccgcgtactgtctggaaaactcaaagcgcagggccgtaatggcgctctctgcggctatgcagtccatggtcccaaagggctggtttaactctgtcaccaccaggtatatcttctcccgaaaactcatcttcacctggatcaggcactgggggacctctcccttctgcctcatataggtgtaattggaataagtgcccggatcaaacggcaccgcgtccctgctgacggcgaactctcttggcgcctgatccgtagccgccaggcaggtcaggttctggttgtatacggctaccgggttgcggatcagcttggagagcacatccagtatctcatccacaccttttcctgtggaatcaggggctatggcaagggctgcgaaattgtcgtgggttgtcttaaaatacttaagcctggtaacctcctcgttaaaaagccgttccataatcagactcatgacatcccggaaggaaacctcgaacggcacctccagaaccggaatgttatgttcctgggcaaatgtaaacagcagttcaatcttggtgtccgcattctccaccttcctgccccgctttaacacaagggcactgacactctttctgctcaactcgttgatatacgtgcggaattcatctactgtacaggatctgaaagcatacagacctgtcagaagtacctccccgccgtcaataaactttacgatgtccggcgcctcaatgattgtcacacccttaatttccttgtccagtcccctgtcgcctgcaagtaccttgatatccttcatttcctctgccaaaagaagttctcttactgttaatcccatcttttccctcaccgccatcatttgtcctgccaacactacctcctaattatagcacaaacagacacagacgtataataaaatatcacgtctgtgtccttttgctatttatatgctatttcatgaccttttcttttgccagcttctccataaccactgccgctttggccagatcgctgtatttggtgaactcaaccgggcaatggctccgtccgtccttgctcggcacaaacagcatgactgtgggaagtacctgaccgatttccagagcatcatggcctgcgccgcttaacatcctcttgcagctgtagccccgctccccgcattctttctccataatatccagcatttcccctgaaagctccacaggagttatggtcagtttgttctccatgtcaaaactgccgccatactcaccaaccgcccgctcaagagcctttctgatcctgtttgtaatatcatttatattgtcgttatttctggaacggatatccactgtgaactccgctgtatccgccacaatgttcatcccgcccggtatggtgttcacatatcccaccgtagcaacggttccgtccgctttttccctggcccagtcagctattcttgagataacctttgccgccgcgtccaccgggtccatcctcatatccatgggtgtggttcctgcatggtcggccctgccgtgcaccgtcaccatgtagcgctgaatgcccacgatacagtctaccagtccaagctctgtgccttccgtatccaggaccggtccctgctcaatatgcgcctccaggaagcagccgatttttccgtcttcccagattgcttctttgatccgctccggatccataccgtattccttcatggcctcatagatggatataccgtctttgtcacggaattttttcatgtagtccacatccctgtgaccaaggatggctcctgagccaaaatagccggttccaaaccgtgttccctcttcgtcacagaatccaaccaccacgaaatctctcttaggcctgattccttcttctaaaaggagacgtgccacttcaatggcgcagatgacgccggctatcccatcatagtctccgccgttatatacagagtcatagtgggagcccatcatgacacagggtaattgggagtcctcaccctttaataccccaatcacattgccggcagcgtcttccctcacatcaagtccgctctccgtcatcagctcctttaaatactctacggcctgcctggcctcttttgtgaacggcagcctggtgcagccgtttcccggtgttgccgtaaactgttttaaatgctccaaatccctggcaatcctgcctgtaatctcctcaatcaccattagtaaaccctctctattctttatttggaaaccaacttgtgtttcctcttatttctttctgtctaatacatataccttaaacggcgagtacagcatagccgccaccagcagaataaatcccaacaggcataccccgtctccctgcatcttaagtcctgtcagtatcagggcaaaggccgccaggatggctgcaaaggccactgtgagcctgcccccttttgtcttgaaaaatttctctgtctccatatgtcatcctcctctgccccggcactgcctgcgcgtcatgaaacagccactgataaaaatacgataataccgattgccagcgtcataatggtcgtgaagggtatgattctctttagcacctgtccctcgcttcccaggattcccgctgtggtagtccccaggatgatattgctggggctgatggcgcttccgatagaacctcccgctgtctgggcgcccagaattggcgcctggttcagatgaagcagattggctgtggttacctgaaactctccaaagagtatattagatgacatattgcttccggtcatgaacgatcccaccattcccaccagaggcgccaatatgacataagtcttgccaagtacccttgctatcccgtccgccagcacgctggtctgccctgttccgcccatgattttggacataatgacaagaccgatgatagcgattcccgacggcatggacatggttatggaacggacaaacacacgctttacgcctcccggacgaatccatccgtgcctgccgaaatacaccagccctgcaatggatgacagaaacaggaacatactggcatgggtaaagggccgcaacggcgaaaattgttccgtagcctggttgacgaatccataccccgtggaagtctccggaaaggaaaatccaatggacacctggttcaggaaacgatttaccgaaggcaccaccagcaccaccatggtaaccgcagtcagcaggatataaggcacaaatgcctgtaccagcgtcatgccgtccggagtctcctccgatgtgccggacgcggcgctacggtccataatccggctgtcctccacactccactcctgtctgtacatcttcattctgcctatcagtatcagggccaccagggagagacaggccggaaggaagcaggctatggttgtattgacccgggtcagaagcagctctccccctccctgaatcagggacaggataaggagggcgggaagccccttcctcacagcctttccttttccgtagaaccagcatataaccagaccaatcaccacattccacatccagatgaacacacctgcccaaaaggcagccgccagatagtcaggcgtaccgggcacaagtccggtggacatggccagggcatcccaggcagctgccagggtaccgaaggtattgccccatgcctgccccaataaaggtataatgaccgcgaatacgggaactactccaatgcccatgagcaggggagctcccactgccaccggtacaccgaatcctgtaattccctggagaaagctctccagtatccatcccagggccagcaccatcaaaagttcattgggcaaaagctttctcatcccgttgcggattacaagaaaggcccgggcttcatccgccacctggtacagaagaatcgcagtccatacaatcagcaggataataagagcgctccatattccttttgcactttccgctgccagcaacctgatatcagctttatagaatacaatgccggtaataatcgtaatggccagccccacgggggctgcttccgtagccccccactggaacttaatcattagcagcagcaggacaatgattggcagacatgccattatccacataaacagatttgttggtacgttcatattttatctcccgattacttatgtattactgtccccgtgctgccggcgattccttccgccgccttgtcaagcaaggtgataagtgtacgcctgccttctccagactgtgcgaaacggatggctgcctcgattttcggaagcatggaccccttggcaaactgctcctgggcaatgtactccttggccttatctactgtaaggtcactgagccattcctggttctccctgccgaaattgatggctaccttttccacagcggtcaggataatcaggtaatccgcctccagctccgctgccagcaggctgctggcattgtccttgtcaatgacggcgttgactcctgagagcctgccattgtcattcaccacaggaataccgcctccgccgcaggtaatgacgatatggccggcatccaccagcgtctcaatggtcttgagctcccggattttcatgggcatgggggaggccaccacgatgcggtaaccccttcctgcgtcttccatgcagggaatcccgttttccatgtttttccttgcttcttcctcggtcaggaacctgccgatgggttttgtgggattcttaaatgcctcgtcctccgggtccacctccacctgggagaggatcgtggatacctttacatccatgttcctcttatacagctcatacttgatggcattttgcaggtcgataccgatatacccctggctcatggccacacaggtcggcagcggcgtttccttgtaattctcatagctgcaggccagctggtccatggcattctggatcatgcccacctgggggccgttgccgtgggtgataatcaggtccatgccctgctgcaccaggtcaacaatcacctcagctgtctttgccactgcctgcttctgctcttcgatatccttgcccagggcgttaccgcccagggcaattactactctttttttatccataaccccatctcccttacatcataagcttagtccaaagagaaccccagtttcttcgcgtatgccgcgattgccttttcaaaacatgcaataggcggatgtacggtgccggcccctatctgtccgtagccagccaccttatgggcgattcccgtattgataactggtgtgatacccttttctaccaccagtctggcatcaatcccaaggcatgttccctggaagttccagtttggtatgataaagttgggattccggtcaatggtaatctccgtcatctccgtactggtacgaagcgcgtcctcgtacccgccggctcccacgaatctggtaacggccggagccgcgatcatggccatgccgcctacgccgaaggtctctgtgatggcgctgtcacccatatccgggcaggcgtcctcaccgtcataacctgtaaagtagagtccctggggcgtgttgacaggagcggtgaaccattcatcccccatgccgcttatgcggataccgaattccacgccgtttctgcacatggcagtgacaatggtgccgtcggttacctgccttgcggcgtccatgacagccttacctgttgccatcatgatattcaggaagaactggtctgtatcagccaggaatttgatgacgtcatatcggtccttttcgtccatatccatcttggtaatcaccgggctgacctctttcaggaaagccagggacgccgcaatattcctctggtggaactcgtctcccatggcgattgccttggctacaagaggattcacattcagtccgcctatggaacggatggcccttccaagggttggtcccagcacatccttcatccacagcaggcggtcaaccacttccttggaatatgcaccgaacctcagcaccttgccgattccctcattcatggtacagtatgcctcattgccgtcggtctggttctcaaccacgaacacaggcatgttggcggaggtaatgcctcccatggggcccacggcctttacatgatggcagggaataaaggtcacttcaccggacgcaagtatctttcttgcttcttcctctgtagcggcccatccctcaaagagtgctgcgccgacacaggaaccctgtaccgggtccggcatgttctcaaaccggattggcggtcccgcatggagaatcaccttgccctcattcaattctttgatgacggacttagccggcaccacatccttgatgacaggctggctggcaaccactttggcaataacggagcggttggcctcatcaatatccatttcccggcagcttctcaggaaattcaggacctttatcagctccacgttgccccctgcgggcggcgcccagtcatactggaccacgtcacatccaaaggcttctatgacctcagcaaagctcttaaggcccacattgatgactcttggcttctgtgacagaagttcaaggagtttttccgatgcttccgttttctggatccgggctgttgtcttggggcggatttccttcaccggctcttcaaagtccagaccgatggcgcggattgccgtatgtacagccagcttattattctcacatacaatgacccctgcttccttcagtgtttccacggccttgtcataaccctggaaatcccttcttgtcccgcatacagtggccacgaagaataattttctcccttcctccctggccttgtcgcgaaggcggatgattgcagggaggagggccccggccatatcttcatgggaaccgtaacccagcatgatgtccaaaaggataacgcctgtggactcgtcgtctatcgcctcctgcatgcactcaatgcgcttggcgggatcaatcatgggatgaggcttgccctgggtgtatacatcgtctcccaggtccaccacgatatgtccgtcggtctttaacataaagccttctgccttctggggcggaaccttaaggttcagggcatccttgattaacatggcagcttcccctgccagggtgcctcctgagtagtatgccttgattgtcttcttttcctctgccgcgaagaagctggaggaatccgcctccacgctgccctctgcgatatcctggcccctcaccagccccacggccaggcgggctgcttcatccagtgtatacgcatggtagaagttttcctcatggtactccggcttctcacccaggaacaaggtgacaaccggtttcttaaagttgctcagccggtcggaaatcctgtccctcaccgcctttgccggaggcttggatatgatgatcagcactttcacggtatcatccttttccatggcctcaatcatatccatcatggtaattccgcctacttcagtggacagatccctgccgccggtgccgatggcgtttttaacgccctctcccagacggtctatgatggtggtcagctcctggatgccggtgcctgacgctccgatgatgccgatgggtcccggagccacgtgattggtaaaggcaatgggcacgccctggatgattccggtaccgcagtccggtcccataacagccagccccttttcatgggcctttttctttaacttaatctcatcctccagcgtaacattgtcgctgaacatgaatacgttcatgccctcatccaatgcccggtcagcctccaacgccgcataagcgcccggtatggaaatcaccgccaggttggcgtccgccagctttcccagtgccttatcccaggaccggaccgcctccgctccctttttatccgactctgaagtggactgtttcttaaagaacgcctccacttcctccatgatcacgtcaagcagcccgtcgtcatccacatcagccactaccaccatatcattggcggacgcctcctccagctcgctggtactaaggccgctctgcctgtaaatatccttgttggcaggagttgccatcatgatggaaaccttctttacaccttctatggaagaaatctggttagtcaaaagcataaggactacagaatcatgataactccctttttttactatggtttttaacatacgctccccttctccttattcggcaaacctgtttttgtggtcatatttatcaaagtgtaccttatcgctctttaaatactcatagatttcatcaactatctccacgccgcctgtggcataggctttatcccgcctcatgaccgcgcgctcacccggataatataccttatcaaagccttctgcggccggcatctctcccagctcatcaagcacctttgacatggacgccttgaatgcgtctaatcccacgaatctggacggatccatgacaatgaacatctgacccagctccctgcctgccgacaggtcatggtacatcgaacttacatgcttcccaaagggaactcccagaagcacgcccgagaaaatgtccaccatcatcatcagtccgtatcccttggcgccttcaatgggtaccagggcattcacaaggctggaatccgtaaccggacgtcccttggcatccactgcccatgtgtcgggaatggattcatgcctggagcgtttgtccagtatcttgccccatgcctggaccgtggtagccatgtcgaatacaaccgttctttcgtcagccgtgggggctgcaaaggagatggggttggtaccgtagtaaggctctatcccgccgtacggcaccgccatcggatcggactggcagcatgcaatcgccaccagatccgccttggcggccatttccgtataataaccaatggagccgctatgggaaatgttgcggatgccaaccactgcgatgccggacttctttgccatctcgatggccttttccatggccagcacagacgctacatatccgcagccgttgtccccttcaaagacagcggaacaaggtcctgtctccctccactcaaacttcggatcaaccgtgatgccgcccttggcaatcctctcgctgtaatactccacacgcacagccccgtgggagtgataacccctttcgtcagaccaggtgaggacatcggccgtcatatccgcatgatccgccttcagccccgcctgcatcagcttatttttcattaacccctttaactcatcatgggaaagtttcatatctgcaccccgcttcttctcaatattctacaactgcacgtctctgttgcaatccttggagtaaatatacgcgaaatcctcttcacgtcccaccgcataacatgcctgcgggcaatatgcgtccaggaacatgtaatctccggcctttaccggtacccagtcattgtcagccctgtacatgcctttgcctgacaggaaatacattccgtgctcctggatatgtgtctccacgtagccgtgggacgctcccagcttgaacttcaggatgtgcatgttcatatcaaatccgaaattacctgctgccggaaggaaatccttgatgtggcagttgtccattccctcatattctgtccagggaatatcattggcatttcccactaccgtaaatgcgctgtatccctcaatcttctcatatctgcgcttatatacatacagcctggcttctttgccgctcttgttttcaaaggaaaccttaacgctctcaggggagaagatataaccgccctcggtaaggctctcttccttgtcggcattcttgacaaccacttcgccggccagtacataaatgaacgtctccagaccttcaccgccaatgccgctgttttttccgccttcctttaccgtaaccagataatccgcaaaggtagctcccatggcaggtgaacccagaatggttacgtcgcagttctcataaccggggatgctgttcttaaccagaccgtccggttccagcagaacataattttccttcttgattacagaacgtgttgccagtaattcctctctgtatcctacctgatcatttaaataactcatatttacttcctcgctttcattctttgttaaaggcctttttgggtcaacttttttatatttatattattgcaaaacaacgctcttttttcaattatgtatttatgcaaatctccctatgatttttatccattttataccctattgctaattttttcacatcccactttttcccggtctcatgctataatatctttaaatataacttatctattatacaaaggagaacaccattatgacggaaaaaagagagataaacctggaacatccagcttatccaaagtatgcaactgtatattcagaaaaggatacagatgcaaaagcctgtatcctttacttccatggaggagggctgctgtacggcagcagggaggatctgccccgaaggcatatagataccctgacccgggccggatatatcatcatatcctacgactacccccttgcgcccgccgccaggctggataccataatgggtgatgtctgttcctccatcacccattacataaatcatcctgaaatgtactgcggacgcaaactcccgttcttcctgtggggccgttccgccggagcatatctctgcctcttagccggggccaaaggcaacctgcctgccgtgcccgcaggaatcctctcctactacggatacggattcctgtgcgaccactggtatgagacacccagcggattttactgctcccttccggctgtagatgcgtcctgcctggaacaggccggtgctgacctccacacggccggaagcctggacacccactacagcatttatgtatatgcaagacagaccggatcctggcgttcccttctgtatgaaggcagggataaatatttctatctggactacaccctgcgcgcctgcaccgcccttccctgcccccttttctgtgctcacggcacccgtgacaatgatgtgccctacggggaattcctggagctgtcaaaccgtttccgcccatggcagttcatcgcctcctgcgatggccacgactttgaccgggatgaagaaaacccgtttacggaaaaactgctggacgagacactggcattcctggaggaaaacctgaagctgccgccggcccagtgctgataactagccttcctgctcctggaaaatggttcctgtgcggaatgactttgcgctcttcatgttcttcatcaggaagtaatacaccagtcccgtgggaatcaggctcacataccaggacagctgtacgatgaccagagagcagagggagccgatgacgatggctatgatggctgcccagttgattcccttgaacacaccctgcttgtcatacatatgattgatattcagcttctttttccggagaatgtaatagtccaccgccattacggcaaaaatcgggcccaggaatgcggaatagaactgggtaaacaggcttaagcccgctgccgaatcatccgtcaccagcttccacggcatacagcatgccgagaggattcctaccaggatggtggcgtgggaccatttcatgtggaatgattccatcagcacataggatggcggaacgatattgttcagcacattggttgtgacctgggcaaatgcaataaacagcaatgtcactactgtgaggaacttgcttcccatggttgtggagaacaccacaaccgggtcgctgttgccggtagcagccgtcacaagcagcccgatcaatcccataaacagcgttacaggcagaatggcaaccgtgtaaatgcttccggtaaaggtgggtcccaccttcccctccaggttacgggaatagtcggatgcattgatgatcatggttgagtagattcccaggaaggaggtggtggctgcccagaaaggcatgccccatgttcccttgattccggagaacacgtcatcaatctcagttgcgaactgtgtcttgaccacatacagcatgtaggccagtattgcgatgatgaatacacaggaaatattttccagccacttgataccctcaaatcccttgatggccagggcaacctgcagcattgtaaacagggcatagaccaggggaaggttgctgaaaccgaacaggatgctcagacagctgttgatggctcccgctcccacccagctctggaaaccaaaccagataatggcaggaatacctcttaacaggccgggcaccttgacgccggtggtgccgaagctgcttcgaagctgtaccgtgtaaggaataccgtacttatgcccgcagttgccgatgattaccagggccaccgcgatgaccagacatccgatgaccatggcaaggatggcctgccccactgtcaatgcccctatcaggccggcgcccatggagaaggtgccgatggatacgcaccctcccatgaagcttgccgcgtaggaaagaggccccataatacgttttttcgtcggctgcagatccggatccacgttctttaccagctccggattcaaattcatattttcaactatattactcatactttctccttttccggggagtgtctgaaaatcacgttctgtcagctcagtctcctgaccagggtccccacacctttttctgctgtaatccttccgtcttcagccaccacattgccgcggatgatggtgcatacaggcagtcctttgcccttcattcccacaaacgcggaaatcttgtttacatacaggagggattcgcctgtaatctcccactccttttccgggtccagaatcacaaggtccgcgtcaaatcccggaagtatgtcacccttttttccgtatatgccgaatgcttttgccggattaagggccatggctcttgccaataccctgggatccacgccccgctttacgcatccctcgttaaacgccacctggaatccgctctggatgccgctgatgccgccccatacgtcaaatacattctcgattttatttcccagaatctctttgaatttctcatcgtaggagcagggagaatgatcgcttgctataccgctgaaggtaccgtcctccacataggtccagagacggtccacatcttccttggaccgcaggggaggcgcgcatttgaacagaggtccgttggcaaggacatcctggtccgtcaggctcagataatgggaacacgtctccgccgtcacatcatagcccgcctgctgggcctcctttatcttctgggccacgtcaggactgctcacgtggcagatatgtaccttgcaccctgttgccttggcaatctcaatcatatccacagtggcaaccatctccgcaatcaccggcctggaatccagaaatccctgccagtccatacgtccttctcttttcatcctggcttcctgccatttaatcatggaaaaatcttcgcagtggaagccggcacggccgccaaattccttaatcctctccatggcctcataggcctgcccgtagtttaaggagctgtaatcaggtgataccggtccgataaaggatttgaaggcaacacagcccttctcatgcaggccttccagttcgtcaaaattatccggcaccaggccgccccagaagcagtagtccgtatatgcgttacagtccaccttctccacttttctgtcaaaaattgccgcgttcgtcatggccggttcattttgaaggggcatgtcgatgatggtggtataacctcccatggctgccgccgctgtcccatgttcataatcctcccgccattcataccccggatcattgaggtgggcatgggtgtcaatggctcctggaaatacatattttccttttgcgtcaatcacctttgcagcctccggctcctgcccggcctccagcagggcggcaatcctgccgtcctttatgccgatattcccctctgtcactgcctgggcggtaacaatccttccatttttcactaacagatcatacataagctttgcctcctatttacttctccagggaagtccctttcctgaaacgttggcaggacggcatatgtttcatgcagaaataatataccagtcctgtaggtatggttgccgtaaagaaggatatgtctacattgacaagtccgattaccgcgcccactgccgttgcaatgatggctgcccagttgattcctgaatgggttccgttatcatcgtagaggtcatccagagccgctccttccatcttccccctgtgcaggatgtagtaatccgtaatcagcacggcaaagattgggccaaagaaagcggtgtaaatcttaacaaacagatccagtcctgccgcggagctgtcgttggtcaggatccacggacaggtacatacagccaggactcccaccaggatcacggccgtcctgtgcttcatcttaaatgcgtccataaacgcataggcaggaggcaccacgttgctggccaggttggtggtcatctgggcaaaaaggatgaatccaagggttgccaccagcagaaccttgttgtgtaccatctgtgaaaatgcgttgatggggtttgcaatccctgttgccgtggaagccattgcgccgataagtcccagaaggacagtggttggtaccatggcgataaaataggcaacaccgcgctttcctacggaaaaaccgccctttaactctctggaatagtcgccggcattgagcataaccgtggtgctgttgccaaagaaagcgatgatggcagcgatgaagggcattccccatgaacccttcctgctgatgagcttatcgccaatcacgccccagtactgggtcacgcatacaaataacatatagagcatggcgctgacgattaccacgccgccgatgttctccacccatttgattccgtggaagccctttactgataatataatctggaccacctggaacaggaggaagaacagcacaacattgtcatatccgaatatggcaatggatatctggttgatggcggagccgcccagccaggtctggaatccgtaccatacaatagcgggaagaccacggatcataaccggtacaatgtttccctttgtgccgtacgcactcttaagctgaaccgcatagggcgcgcctgatttgtagctgaaacggtcatttgcacagatgccgataaccagtatggtggagccaatcagcaccgccaaaaatacctgcatcaggttaagccccttgtccaactgggcagaccccatggtcaatgtgccgatggaaatacatcctcccagccacagcatcaggtaggatccccaccccataatacggtccttgtcctgaatcggcgccaatgaatctgtttgcttatttacttcattttttacatcgctcataatatcaccccttattttcttctcctcgtattaacagtcatgtaccggagtcacgtattccccgtagcccagagcgtcttccctataggtttcgccggaggcaaccaccttgccccggatgatggtgcatacgggagcgccctttccttccagaccgtcgaagcaggatacatgccccttggtcagcagttcattctggctgcatttccaggccttctcaggatcaacaataacaatgtccccgtcaaatcccagctcaaaggcccccttccggccgtagaggccgaataccctggccggattgtagtccatcaccctggcaatcagggtggggcttaagcccttcttgtttaccaccatgtcaaacatcataggcaggaagaactggatggagttgagaccgccccatgcatgccagatatcctttgtggaattgtccttttcctcatccgcagccggtgagtggtcgcttcccacacaggataatgtgccgtccagaacataatcccacagccgttccatatcctctttcctgcgcataggcggcgtacacttggccggagcgcccttctcaaagacaaagtcctctgtaaacccaagatagtgtggacatgtctcagccgtaataggaagcccttcgtggatggcgtcctttacaacctgtgccaccatggggtggctcacatggcagatatgcactctgcccccggttgccctggccatgtcaatcacatttttagtggcaacatactcggtccacacatcatgggaatccaggaaatccctgattttctcttcgctggtccttccggtttttgcctttgcctccttttcccgttccagcacctgaccgaactcttcacagtggaaaccgcacagggccccgtaaggctttaagatttccagagcctttctcacattgcccatgttcacggttgggaacaaatcgccgttggggcaggtaaaccctttgaatgcagccacgccgcatttgtgcaggtccaccagatccgccatgttgttcttcaccgaaccgggctgattgtcataatcccccacaataccgccccacagggcaaaatccacataggagtgcttgctgatgcgccccatcttcaggtcaaagatttccttattcatcaaagacggatcattgttcaagggcatgtcaatcaggcaggtacagccagctgccgctgccgccctggaaccggtctcaaagtcctccctgtattcaaatcccggttcattcaggtgcgcgtggcaatcaatgattcccggatatatgtagcatccctttgcatctatcacttcttttgcagccgcctgcgaccccttggcaagaaaggcagcgtagaccccgtcttttaccgcaatatcagcttcataaatcctgtcaggggttaccagctttccgtttgttattactaaatcatacattttttacctccttacagactgtaaatcgttgaccgtttcaatacttacgttgtattttattagatacacagtcagaaaacaatgacgagaaaacggggaaaaattatgtttttttgtctatcatgtataaaactatattattttgaaatttgtttttgtgtttttttcgataatctggtaaaatttattgttgaagcattgtcataagtgcaataaacagcatagcacagggagaaagcaaatgtatcctaccatcaccgccattgccgcctacgcagcacagcagctggaggagtgccgtttctggacggtccactctgtctacaaaaaaacagtgaatcttcaggcaggagagcgccttctggccctgcaggccgcatcctctcccatgtctcctatcagcatcataacagacatggatgtcagggcttttgaagttctaccggtcaaacctggccagcaggtgtccattgccggcagccgaattataatatcctctccgggacacacagtggatttttggtgccggccgaaaaaagtctgctgcacccggttaacctgcccgcccgggccgtttccctgcaaagagcttctctcacgggtccggcaggccgtcgccagctcgcaggccggtatattccgtcttctgttctgcgattccacggaggaccagacaatgaaaggcaaagaggaatacagcctaattctggccgcagccggaagccgaatcctccaatgcagcgaatgtctggaacagcatttgtacggagatgctgccaaacacctggcaggactcataggactgggaataggccttacgccaagcggtgatgattttctgtgcggggtgctggcaggactcatcctgcgcggagaggaaaaccatccatttgcgcacgctctctgccgggagataacttcccgccggtttgataccaatgatatcagccgcgcctttttggactgctctgtgcagcaccatttcagcctggctgtcaacagcctgacagaccttccctctgccgataggattttaaacgtattctcagacattgggcattcttccggcattgatactttatgcggggttgcgtacggactctccgcagaggtataaggatggggttcagacacaacaaaagcgcaggcttctgtgcctccccggaggagtatcacagcacagtgcctgcgcttatatataatctattatattttaaagttattaccgccttgtaaggatagaatcaatcagcccatactccaatgcctcctccgcgctcataaaattatcccgctctgtatccctggctatttcctcctcggagcggcctgtattcaccgccagaacacggtttaaacgctgcctgcttttctgcatgtaatccgacatgattttaatgtcgctggcagggccctggattccatttccgtgcatggcgggctggtgtatcatgatttcggaattgggaagggccatgcgttttccatgtgctcctcctgccagcaaaaaggccccgaaactggctgccagtccaaggcagatagttgaaacgtcgcatttaatatactgcatggtatcatatacagcccagccagctgtcacagaaccacccggactgttgatgtacagctggatatccttgtccggatccgcggattccagaaacagcagctgggctataataaggctggcggaagtgtcgctgacctcctcgcccagaaagataatacggtccgacagaagcctggaatatatatcatagcttctctctcctcttcctgtctgttcaatcacataaggtatggtactcacgctgcaatccctcccattctgtcacaaaccccatatactgtaaaacaggaggcttgatgcatttgaatccgtttctttgcaggctgataaatccccctttttctgtacgctccgggcggacataaatatacctgtttaaatgcgagagaaaatgcctgctgggactggtacccgacatcgtaggctatctgcgtgatgtccatatccgtatccaccagcttctccgccgccatggtaagcctgcgctcctgcacatatttatgaatcgtgcctcccgtctcatccatgaatatccggttcagatggaacctggaataacctgcatgctccgctatctgctccagattcagctcctcctccaggtgttcctcaatataatcaatgacctttctcactgtatgcttttgattcttcattctgccacctcctggtctggttcattttattataacaggagggagccggattgtcttaataaaaagtgcgttttgtaacgcaataagccggggcaggattttcgcaaatcccgccccggccattacccgaacacttaatatggactttaatacagcttcgcacccgccggaatatggtcatctacaatcaggagatgaagtccttcatgtccgtcctcctcatgaaccgcagagatcagcattccgcaggaatcaatgcccatcatctttctgggcggcagattcacaatcgcaatcgctgtctttccaatcaggtcttccggctcataatactcatgaattccgcttaaaatcgtgcggtctgtgcctgaaccatcatctaaggtaaactgtaaaagtttcttactcttgggcactggggcacagtcttttatctttacggcacggtaatcagactttgcaaaggtttcaaaatccaccatttcctcaaacagcggctcaatttttacgttggaaaaatcaattctttctgccggttttgcttctgttttcacttctgccgaagctgccttttccacctttttcgctccatcggaaccgcccagtgtcttcatggtggggaacagcagcacatccctgatggccggtgaatccgtcagcagcatgaccatacggtcaataccgaatccgattcctcctgtcggaggcatgcccacctccagagcgtttaagaagtcctcatccgtgtggttggcctcctcatcgccctgggccagaagctcttcctgtgccctaaaccgctccctctggtcaatgggatcattgatctcagagtaggcgttggccatctcccagccgttcataaagaactcaaagcgctccacataatcgggattgcccggctttttcttggtcagaggtgaaatctccaccggatggtccagaacaaaggtaggctgaaccaggtgctcctctgcaaactcctcaaagaacagattcaggatgtcgcccttcttatggcgcccctcaaactccactcccttttccttggcaacggctcttgcctcctccagggtatgaatctggtcaaaatcaactccggcatacttctttaccgcgtccaccatggtgatgcgggcaaaaggcttgcctaaatccatctccacgcctttataagtaatggtggtggtaccaagcacctcctgagccacaaaacggtacagcttctcggtcaggtccatcattccgttgtaatccgtataagcctgatacagctccatcagggtgaactccgggttgtgcctggtatccagaccctcgttgcggaatacacgcccaatttcataaaccctctcaagtccgcctacaataagcctcttcagataaagctccagggatatacgaagctttagatcctcatccagggcattaaaatgggtctcaaaaggccttgcggcagcgccgccagcattggaaaccagcataggggtctccacttccataaagccctctccgcccagatatttgcggatggcagccagtatcctggaacgcttgatgaaggtatccttcacctctgcgttcatgatcaggtccacgtagcgctggcggtaacgcatatccgtatctgtcaggccatggaacttctcaggaagcacctgaaggctcttggaaagaagggtcacctctgtggcatgaatggatatctcgcctgtcttggtggtaaaggcagttcccttcacacccacgatatcgccgatgtccattttcttgaaatccttataagactcctcacccacgctgtcccttgccacatagacctggatgctgccttttaaatcctgtacattacagaaagaagccttgcccatgacacgtttgaacatcatacggccagcaatggctgcttccttcccctcccactgctcatagttatccttgatatccatgctgtgggcagtcacatcatattttgtaatctggaaagggtcctttccagctgtctgaagctccgccagcttatccctgcgcgccttcagcacatgatttaaatctgtatctgcctgattaaccttctgctgttctcccacgtccttaactcctttgtgtcagatttatgaaaccctctggatttccagcaccttatactggatatcccctgcctgggtctccacgtctacgcagtcacccactaccttgcctatcagggcgcggcctaccggtgattcgttgcttatcttattctgcaggctgttggcctcggtggaaccaacgatatagaactccatctcttcgtcatactccacatccagaagctttaccttacatccgatattaattttatccaggtcgatttcatcctctactacgacctcggcgttcttaagaagcttctccagttcctcgatacgcagctcaatgtccctctgctcatccttggctgcatcatactctgcattctcggacaaatcgccctgctctcttgcttccttaatcttctgcgcaacttcttttctcttgacaactttcagattctgcagttcatcctcgtactgtttgagtccggcatatgtcaaaatgtgtttcttatctgccatcttacccgcttccttcctttaattcttactttatgttgatttcacttgagtatcattcttaatgtccacacattctgagtattatataggaaaatgtgtccattgtcaagattggattttcctgtccagaagctccacgaaaccctccaatgtctccacctggttgatttcattcctcagtgtggctgagtggggcattccttttgtataccaggccatatggcccctcatttcccgcatggcaaccccttctcccttgaactgtaccagcatccggccgtgccgcagaatcatggcctttatctcagccatggaaggccccggaagaacctcccctgtatccagatagtggttaatccggccgaacagccacggattccccttggctcccctggccaccataatgccgtcgcatcctgtctccttaagcatcctgccggcgtcctccggcgtaaagatatccccgtttccgatgacagggatccgtaccgcctccttcacctgacggatgatgtcccagtccgcctttcctgaataatactgctccctggtgcgcccatggacagccacagcggcaacgccgcagctttccgccatcttagcaaattccacggcattgacagagaggtcgttgaaccccttgcggaatttcacagtcacgggctttttcaccgctttcaccatggcggtcagcacttcctttgcccgttccggattcttcatcagcgcggatccctcgccgttgttgacgattttcggcacagggcatcccatgttcacgtcaatgtaatcatagggtccttcctccagcctggccgcaatctccgccataatgtccggctccgagccaaagagctgcacggctgcggggcgctcggccgggtctatctgcagcagttccctggtgtttttgttgttgtacagaaccgcctttgcgctgaccatctccgtcaccacgcagccagctccctgttcccggcacagcacccgaaagggcagatccgtgacgcccgccatgggcgccagtattacattattctcaagaactgtgtttccaatcctaagtttcatttaatcttccccgtcatcctctatatctatgtcctcgcccaggaaaaatgtcctgtaatacagttccagcgcttccagcatttcttttttctcttcctggtactgcttgattttaaggacgcttcctatctcgtcaaagagataatccgtttcctccgaggtcaccctgaattccaggtttcccctttcgtcaaattccatggtaagcacgccgcccacatcctctgtatacatcacacacatgatctggagctcgtctcttatggactggggcagggatttgaaatcctggttaaaataatatttttgttcataggaattggctccgcaaagcactgttgtatccttcatctcatctctccacaaaagtccgctgcctgtgacaggcggcggactttccattctatcgtcgtttatgttctcacgtaccggactagcgaatcagcatcttggcaatctcatactgctcttccgggatgtcctttgtcatattcagggcttcctggatatcgaaatccacaaactcaccgtgcttataggctaccaggcggttgctcttgcctgcggccagaagctctgctgccttggctcccatgatggaggcatataccctgtccttacaggtaggcgttccgccgcgctgcatgtggcccaggatggtggcccttgtctcgatgcccgtggcagcctcaatgcgctttgccatggaaccggaatggccgattccctctgcattgataatgatgttgtgtttcttgccccgcctgcggttgtcgataatccggttaatcagggcctgctcgttgccgtcatagcgctccggaagaagaatatcctccgcgccgtttccaatgccgcaccacagcgcgatgtatccggcgttgcgccccataacctccacaatgctgcaccgctcatgggatgtggaagtatcacgaatcttatcaattgcttccatggccgtgttgacagccgtgtcaaaaccaatggtataatcggtacaggcaatatccaggtcaatggttcccggaaggccgattgtattgatacccagggaggacagctttcccgcgcctctgaaggaaccgtctcctccgatgaccaccattccgtcaatgccatgcttgcggcagatatcagcgcccttctgctggccttccgctgtggtgaactccttacatcttgcagtgtaaaggatggtgccgccccgattgatgatgtcagacacgctggtggactccatgtccacgatttcctcctccagcaggcctgcgtatccgcgcatgatgccctttaccttaaggcccttattgatagcagtccttacaaccgcgcggatggccgcgttcattcccggcgcgtcgcctccgctggtaagtactccaatggttttcactgcctttgccatagcaatttacctccttgtattaagcacatacatttcttctgtgctgacatcgctctcaatcattcattctctcatctatatccaacgctattctaattcattttccccagcttttcaagacctttttctacgactttgacatttttttcaccaagtcccctccccagctcttccaaaagcccgggcgtaacctgtacattccagttggccggaaggactttcttggccctctccttctggagataaatgaccacccggtcctttccctcgctggaccgcagagaggtgagcagacgctgctccccggactgatacgtctccatatccgggaactggagccacagctccttgggtatactgtcaaagggaatcacctgctcgcacaccagctttcccaccggatcgtctccgatggacacccttcccctgatgaacagcttggaatcctcggtaaaaaggtcccggttggcctcgtaatcccttgggaacacaatgacctccaccggtcccagaaggtcctccagggttatgaaagccataagctggttggtcctggtggtctttacggtcttgcctgccaccagcccgccgatgacagccctggatccgtccgccacccctgccgcgtccgtctcctcatccaccataaactgggctgaggtggctgttatgttccttctccacgtctcctcatagtcgtccaggggatggccgctgatatagactcccagtatttccttctcaaaggcaagaagctcatcctttgagtattcccccacatccggaaatgtaatctggaattcgtttctgtcttcctcacccgcaatgtcgaaaaggcttaactgcccctcaaacatggattttttctccctggccttttcctccagcatggtgggcgccaccgccattttctggcgcctggttccgggcagggtatccagggcgcctgacttgatgaaattttccagggttctcttgtttacttccttcatgctcatgcgtcccacaaaatcctccatggaacggaagggaccgtttctctccctctccgccaggattacctctgtcacgggtttgcccacgctcttgatggcggacaggccgtaacggatagcgtcccctgacacggagaagccgctctcgccctcgttgatatccggcggcagcacgggaatccccatcatacggcggcaggtcagcacatactcggaaaatttacttacattgtccatgaccgatgtcatgagggcggccataaactctctgggataatagtatttcagataagctgtctggtaggacaccacagcgtaagccgctgcgtgggacttgttgaaggcgtattttgcaaagtcaatcatctcatcgtagatgtggtttgcggtcttctcgtcaatcccattgttcacacagcccttaaccccttccgactggctgccgtagacaaagttctggcgctccttctccataaccgacgtctttttcttactcatggcgcggcgcaccagatcgctgcgtcccatggtgtatccggccaaatcacgcacaatctgcataacctgctcctggtacacgatacatccataggtggggcttaatatgggctccagctgggggcagtcataggtgatggaagccctgtcgttcttgcccttcagatatttgggtataaaatccatggggcccggacggtacagggagatgcctgctatgatatcctccaggttctccgccttaagctccttcatgaagctcttcatccccgcgctttccagctggaacacgccctcggtcctgcctgttccgatggattcaagcaccttcttatcatcaaaatcaatgtggtcaatgtcaatggttatgccgtaatccttctcagccagccgcaccgcgttctggatcaccgtcagggtccgcagccccagaaagtccattttaagaagtcccagctcctcgatggttgtcatggtaaactgggtggtgatggtgccgtcagaggccctggacagagggacaaactcgtcaatggaccggctgccaatcactaccccggccgcatgcatggatgtatgtctgggcagtccctccagacgcctggacatgtcgatgagataatggacctgctcatcttcattgtaggccttcttaagatccggattcatggtcagggccttatccagcgtcatccccagatcccctggaatcatcttggcaatggtgtcgcacagggagtagggcaaatccagcacacgccccacatcccggacaacacccttggcagccagggtaccaaaggtgacaatctgcaccacctggtccttgccgtacttgcgcaccacgtagtcaattacctcctggcgccgctcgtaacaaaagtcaatatcaatatcgggcatggacacgcgctccgggttcagaaaacgctcaaagagaagattatagcgcaccgggtctatgttggtgattcccagtgtgtagctcacaatactcccggcagcggatccccgcccaggccccacgatgatatcctgggatcgggcatagttgataaaatcccacacaatcaggaaataatccacgtatcccatggagcggatgacatccagctcatagtccagccggctgctcagtgtgccgtcatcgtccggatagcgggtcttaaagccctcccggcacagatggtttaagtagctccaggagtcaaacccctcaggcacctcatatttgggaagtttggtaaccccgaactcaatctccacattgcagcgctccgctatcatatgggtgttttcaatggcctcaggcgcataggggaacagagcccgcatttcctcctcggacttacagtagtactgtcccccctcgtagcgcatcctgtcctcatccgccaccttcttgccggtctggatgcacaaaaggatatcatgggccttctcatcctcggcaaaggtgtagtggatatcgttggtggccaccagcttaaggcccgtatccctgctcatgcgcataagcccctggtttaccagcttttggtccggcaggccgtggtcctggagctccaggaagaagttgtcctttccgaaaatatccacatacttttcagatgccctgactgcctcctcatacattcccctggtcaggcagcgctgcacctcccctgccagacaggcgctgagggcaatgatcccctcatggtaggtccgcagcacctcatagtccaccctgggtttatagtaaaatccgtccacaaaccccttggacacaattttcatcaggttttcataacctttgttgttctctgccagcagcaccaggtggtaataacggtcctcaccgcttaccgtctccctgtcaaagcgggagcccggggccacatagacctcgcatcccagtatgggcttgatgccggcctccctggcagctttataaaaatcaatgactccatacatcacgccatggtccgtgacagccatgctgtccatgccaagctcctttgccctggctgtcagctccctgattttacaggagccgtccaaaaggctgtattccgtatggacgtgcaaatgggtaaatgccattccctattctctccttatccttgcggtatcattcgagtaacagtttatcataaatacagataaaagaaaagagaaccaggcaagtcctgcctgattcccattatctatctctccaaacaaacggactggtagttactggtttttcagatacttctcaatttcagttacagctgcctcctcatcttttccgtcggcttccaccaaaatggattcacctgcggtcagacagagagtcatcattcccatgatgctcttggcattcacacgctttgcctctgcttccaggtaaatcgcgctttcgtactgactggctacctgcacaagcatagctgccggtctcgcctcaagtcctgatgccaattcaactgtaatcaatttctttaccataataatcctcctcattcctttgaatggttcacagcccctgatacgttccaatggtcatgttccaatctggccgcatcccgactgccattcaggtgcccgtactgattcgtacttgataaaactattgcaaacttgatgtattacggtctggaaactgctgccgcagctcttcggccacaaggcttaatttcctcaaacggtggttcacgcctgatttacccacaggcggttccagggcctcccccaattccttcaaggtcgcctccggccgttccagccgtatgcgggccatctcctgaagactctcaggcagacccgaaagaccggcaacagactgaatgaaacggatgtcttctatctgtttcaccgcagctgacacagtcttattgatattggcagtctcgcagttgacctggcggtttacgctgcccctcatctccttgacaatgcggatattctccagctccataagggataccggggcctccatcacattaaggatgtccacaatctggctgccctccttgatatagaccacatagtacttcttcctgggcactattttggcctcgatatcaaaggtggcaatgatgtttttaagctgctccgcctttggctcggtgggacacacgatttcaaagtggtagaacttctccggggcgctgatggaaccggccgccaggaaggcgccacgtatgaaagcccgtctgcagcaggcattctgaagcaccacattccggatcagggaaaggttttcaccaatttccccctgggaattgatgagcttcactgcctgcaggaccttgagggcttcctcatgttccctgactgctacgatgtatgtcctgctccgtccgggatttattccactgcgaatcgagacatcagttcttatattaaatgtttttttcaataatgtaaagtactttcttgcaactgccacattttccgtatggatttcaatccaaaaatggtctgaggctgatatctttacccttccgcacagactcaggattgctgctgtctctgctatctggcagtggcgcgccccaggcatctgcctggacagctcgtcttttacgctggaagaaaatgacatgtccgctacttccttttattgtctttgtcgatgtccctgtgttctattttaatgccgtattcggccctggcagtcaggtgggcgcaaagagccctggcaaccgtcacggagcggtgcttgcctccggtgcagccaactgccaccactaactgattctttccttcattgatataattaggcaggaggaaatccatcatgtcatagagcttgtccagaaactgggcgcaggtgcctccctgcatcacataatcccggacagactggtcctcccctgtcagcaggcgcaggtcctccgaatagtagggattgggcagaaaacgcacgtcgaaaaccaggtccgcatcctccggaatgccgtacttaaagccaaaggaaagaaccgtgacaaacatgttgcagtactcctggtgtttgaggaatatcttttccagctcctgccgcagctccctggtaaggagcttgctggtgtcaatgatgaaatccgcgtcctttttgagaaaagccagcttgaccctctccttttcaattcccttgtccagcctgcctgtcccggccaggggatggctgcggcgtgtttccttgtaccgcttaatcaggactccgtcattggcatccaggaacagaatctggtaatccatccccagttccctccatccccttagaacagcatccagctggttcagttcctcaccgctgcggatgtctatgcccagggcggcctggctgatatcgctgccggccgctgccagctgggcaaatttatccaccagggatatgggcaggttatccacacagtaaaagcccatatcctccagcattttcagtgcaattgtcttgcctgccccggacattccggttacaattacaagcttcatccatccacctcagttacgtaaaattagcattaaaggtcaaaattccccccagcgcttcacttccatctcaagctccacgccggactgttccagcactgtctttctgatatgtccgcacagggccatgacatcggacgcagtggcgtttcccccgttgatcacaaaaccgcagtgcttctccgataccctggcgccgcccatgccgtatcccctgaggccggcatcctcaatgagcttgcccgcaaaatatccctggggacgtttgaaggtgctgcctgcgctgggatattccaggggctgtttctccctccgtctggctgccagttccttcatccgggcctcaatggctgccccgtcccccggttccagctgaaaggatgcctccagcaccgtatatcccctgccggggatacagctggtgcggtatcccagctccagctcatccacggaaagctccagcacctctccctcatttgtcatgaccctggctgatttgaggatattctttatctcagagccataggcccccgcgttcatcaccagggcaccgcctacgctgccgggtatgcctgcggcaaattccatcccggtcaggcagtggtccagggccacacgggccacacggcccagcagttcacctgccccggcgcgtataacgcttccctctgcccctgcataacaccagtttccttccatggcaatgaccacgccctttattcccctgtcgctgaccaggagattgctgccattccccagtacgctccagggaatgtcatgttccctgcacagacagatgaccttccccagctcttcttcattgccggggcatacataggcttcagccggccccccgatgcggaaggtggtgtggctgctcatgggttccatgaaacggcacaccgcgccttctgatacaagcacctctttcaacatatgttccagattcaaaatacattcctcgcttacgactaattttcctggccctttcccaaattggcctgtacccggttgtacagctcctgggctgcattatagcccatcttcttctggcggtagttgacggccgcggactccacgataatagccaggttgcgtcccggacggatgggaatggtatggcagaccacctggttgcctaaaaactcggtgtactggtcttccaggcccagcctgtcgtattccttatccttgctccagtcctccagcttgataaccatgtcaatggactgggtatccttaacactctccacaccgaacagggtctttacatcaatgatgccgatgccccgcagttcgataaaatgcttggtgatgtcaggggcgcttccaatcagggtatcatcgctgaccctgcgtatctccaccacgtcatccgtcaccagacggtgtcccctcttaatcagttccagggcagcctcgctcttgccgatgccgctttctcccataatcagcacaccttcaccgaatacatcaatcagcacgccgtggatactgatacagggagccagctttacgttgagccagcggatgatttctgccatcagggcagaggtggtcttatcagacacaaggcagggaacgccgtagtaattacagaattccaaaaggtcctcatccggctcctggtcccggctgaacaccagacatggaatctggctggatgtgagcttatcgtacatccggcgcttctgctcctggtccatggtattaatatatgcctgctccacgtatccgatgatttgaacccgctccctgtcaaaatgatcaaagaatcccgtgagctgcagggccggacggttcacatccggatgcgtcagcacaatcttgtccgtgtcaatctccggcgtggtgtttttaagcttcatcttcttgattaattccgatatggttactccatgcatgataatacccccttgacctggtttcgcttctcgtttaacttctatcatactatcataatttagttcggttgtcatgtatttttatcattgtgtttccataatttggaagtccgtttccgccctgtcatccgggtctgcgcaggtgccggacttttcattggcctgcagtgcggcctggcctccggtccggtcactttccttatccccatggaaaaagcggtatacggattcagccgacctgcggttcatttgcggcgtctgctccagctcttccacggaagcgcttctcaccgcctctatatccttaaaatggcgcataagggcctttcttctggccggcccgatacccggaatgtcgtccagtatggattttacctgcccctttcccctaaggctcctgtggtattcaatggcaaaacggtgagcttcatcctgaatcctggtgataagcctgaacccttcggagtgacggtcaatgggaatctccacattattatagtagagtcccctggttctgtggttatcatccttcaccataccgcacaccggaatggaaagtcccagcttatcaaggacctccagagcaatgtttacctggcctctgccgccgtccatcatgatcaggtccggaaacctggtaaaacttcccatgcttaaatcggcgcccttttccttcagctcctctgtctccctcataccgtgagaaaacctgcgcgtcagcacctcttccatggacgcatagtcattgggaccctggactgtcttgatgcggaattttctgtaatcgctgcgctttggcctgccgtcctcgtaaaccaccatagaacccacggactccacgccgctggtattggagatatcgtacgcctccatgcgccggatgcccccgattccaataagctctccaatctggttgatggccccgatggtgcgaagctcctctttcttaatccgttccttatcctgggacagcaccagggcggcattcctggctgccagctccaccaggcgttccttctctccctttttcggaaccaccagcctcaccttctgtccccgtttggcggacagccactggctgatgacctcctcatctcccaaaggatgctggagccacagttcccttggaataaatggtgtgcctgcatagaactgctttacaaagctgtccagaatttcgccctcattttccgccgtggcagccgatatatgaaaatggtccctgccaatcagcttgccctcccggatgaagaacacctgtaccaccgcgtctctctcatccctggccatggccacgatgtcccggtcctccatgccgctgctggtaatcttctgcttctgcgccacctgcttcacgctgtttagcagctcccggtactcaatggcccgctcaaactccaggctgtcagaggcagtctgcattttttcctggaggttctttatgagagggtcgaatctgccgttcaaaaagtccagggcctggttaaagttggactggtattcctccctggaaatataaccctggcacggggcgtcgcactgcttgatgtggtaattgagacacggccgctcctttcccgtatcctttggcagattccggttgcaggtcctgatccggtacaatttgtgtattaaatccagggtgtcctttacagccccggcgctggtataaggaccaaagtaacggcttctgccgtcctttttcatgtccctggcaaacagaaggcggggaaaatcctcccccatggttgccttgatataaggatagcttttgtcatcctttaacatggtgttgtaccgcggcctgtgctccttaatcaggttgcactccagcaccagggcttccagctcggaatccgtcaggatatattcaaaccatgcaatatgggacaccatctgttcaattttggccgtcttattcctgctgctctggaaatactgcctgacccggttcttaaggctgatggccttgcccacatatataatctcatccctgtcattgtgcataagataaactcccgggctggccgggagtttcttcagttcttcctctaaatcaaacaatacctgtcaccatccttttcatatggccctatattcagatgctttttcgttttccggcatgccgttttaccgggctgcgcctgccggcgggacagtctctggcggaacgttctctggcgggaatgtctctgccggagcgttctctggcgggacagtttctgccgggactgattctgccggaaccttctctgcagcgtccccctccgtctccagcgccgccctggactgggatatacgctggtcctcttcctctgcttcctccggagtcagcaggccgccgtagtgataactgacccctgcatcccagagaatccactggtcatagccggcatcgtagacagcctgtatctgctgcctcacctgttcatcgccatatttaatataatgttccagataggacgcagtaaagtcctgaagccacggccttaccacggcctgcggcgcatcctcctttgcggatgcggccagaagctccctggaaccattcaatgcatttaatattgtatcatacggctgggtatccggatactctattccaaaatttcccggcccgtagtgggatggataaatcatggggcatatataatccagctgctccgccatgtcctcatattcctggcccacggcagccgcatcctcttcgctgcgcataatggtgccgaatacatcagccgacacaaagagtccttcctttgccagctcatcatgggcatagcctacgaactccgtaatagcctgggtcttattgcgtccctgggtatccgcgtcgtcaaaaacaacatcattcatggtcctgtccacggcaaaccggatatagtcgaactgaatctcgtcaaatcccgcttcgcctgcctttttacccacctcaatcagataatcccagacttccttcttataaggatttacccatgcaaggcctttattatcccggtaaatcttgccgtcacccacatgcaggctccattccggcttctgttctgcaagatagggatccctgaacgccaccaccctggctatggtatagattccatgctccttaagctttgccataagcgcaggcatgtcctggataaaaacctggcatgcccctatctcatttaccgtaggggaatccatggcataggtgatccttccctggtcatccttcacatcaatgaccactgcattgagctccgtcctgtcgatctcctcaatgatcttatccatcatatcaccggtaccggccacataggcggatacatagatgccctttacctttaccgggtttctgggcgggtatgtggaaatggttatgacctgggaatcagccgcctctgcctcctgggtctcctgcccgttctgggcccctgatgcctcagactgcacagactcctcctgggctctggtcatttcctttgccggttcataccgggaacatcctgtcattgcaaggattaatatgcctgctgctatccaccttttcatacgtaacctctgtctttcccaattatcttatgattcctggaaattcccatttccattcttaatctatatcaaaaaggcaaatgcctgtaagttcagtgaatcagacctaaacatccgttcgttcccactataataccatattctccctgttttgtatataaaatatgacttttttgttacaaattcattaatttctcccactttttgtaaatactcacatctcccccacatcaaaaagcgcccggacaggggctgtatgcctttgtccgggcgtgtgccgggccggcatggggccggaccgtgtttcttatagatgcttataatttcttgaaagaaatatgtctaagcctctgccagatgtctctgaagggcagcccttacagcgcccttgcctgcaatcagctcagagaaaatgctctccacatattcgcccagccctgcctcatacaggtccactccgaatatcttggcatcgcttaaaacaggctgaagcacttcgtgtacattgcacggctctcctacctttacgccctgcagcttctcagccagtcccgcatacatggggtccgggcttacggcaaaggtattgccctcatcgtctacccccagcaggtaacggcaccatcctgcctgaaccatgggtatgaacttaagggacttcacatccagctcaggtcttgccatgtattccttaatggtctcaccgaaacggatagacagcttctgggatgtgtcgcaggcaattctctgtggcgtatcaggcataaaaggattgggcacgcggatctgcaatacctcgtcaataaacttcttaggagaaaggatgccgggatccgtaaccacaggaagtccttctttgtaaccgatgatttccaccagcttcaccaggtctgcgtccttcatctcctcgctgatcttggtgtagcccaggagacagccatatacagccagggtggtgtgaagtggattcaggcaggtgcacaccttcatgcgctccaccttttctacagtatccctggtagtaaacatgacgcctgcatgctccagcccggggcgtccgttggggaacgcatcctcaatcaccagatattcagcttcctctgcattgacaaaaggagccacatatgtgttcttgctggtgacaatgctctctgtatctgtaaagcctgcctcctccagcatcttctttacgctgtcatccggacgtggggtgattttgtcaatcatgctccacgggaaggaaacatgcgccggattctcaatatactccagaaatccgctgtcagcctttccgttctctgtccatgcctttgcataagcgtccacagccgcatacaacttatcgccgttgtgggaacagttatccatgctgaccagggccaacggagctgcgccatgggtatatctccagtaacacagggcagcgagcttaccgatataactgtctgcctgttccggaccagcctcaaaatcagcctttacgtccggacggaaggacccgtctgccgaagtgatgctgtagcccttttctgtgatggtgaagctgaccatctgcagggtcttgctggcaaaaatatcctttaaacagttccagtcctccgcgtcctggcgatccacggtcagggactgggcaaggcttccaatcacagttttctcaatggttccattggctttcagtgtgaccaggaggcttaagtcatcctgaggcctgtatgcctttttgatgatttcatagtcataaccttctgcaacgatgattccggtcttttcaacaccatcgttcagcagcttctgctgacacgctgcaggaaatgcgcggaagatatttcctgcaccgaaatgcacccactgcggacactccctggtagctgccttcatcgcttctctgtcaaattttggaagttctattcctgccgcttcccactcttccttattcctcagttcactgtctaataaatgcataaccattccctcctgtgtttgttgatttcatgatttaatattaccaccctgagggtgaataatccatatccctttttgttcaatacattgcaaaacttgctgtagcaaccccgtgatttgttaaaaacaatggggcctggttttaccgcatcaaaaaagaccagcatccgcgccggtctctcctcataactgctgaacctcaaaaaatactgcatcgtcactgtatcaccgctgatacattggaattctctgtctggtcaaacaaatcatccccgttagccgccattgcatttaccaaaatcagcatcgccgcaagcatggcccacgcaaagccgcccagtaccttcctgactttcattctactctgcctcctggattcataagcctgataactgaagattacatgcttaatttcactccgttatcccattatacaaacttttatgaaaaaagcaagtccttttcctcttacactgtcttacattttccttaaaagccccatatttcaatggattttactgaactagaatttttttccataaggggaaaacaacctgattccagcgttctttagatagattctaaggaaaatgaagggcaatgggcaatggattttgtccgcctgacatatgtccatcccctctccccttacggctaaaatggaatttttcaccttttttgtaggcaaattctgcatatccgggatatgagccatttttttaggtaaactgaaattaccttatttttctatctatataatatacacgtaagaaaagaggatacaccgtgattacatatgaacctttttggaacacgctcaagaattctgacgaatccacctataccttaatctataatcataacctgtcaagctccaccatagacagactccggaaaaacaagccgttaagcaccacaacgctcaatgacctctgccgcattctggactgcgacatcaatgacatcatatcctaccaacgttctgaaagtgaccagtttctttagaagggacacatgctttccttcctccttacccggtttttggagatgatttgctccaggcctaattgccttggaccgctgcgctgcgaacagcaatggctgaagccatttctatcacagcatccatactgtccctggcatcatcctcccaaagttcatagaacacaccctcatgctcccaggaaaccagtataccgtggatatcggaattttccactgttttttggattgtcattttcaccagtttctctccggcccaaacctcctgctgcagagtcccctcctcgtcaaggacgtagtattccgaggggccgcctcctgcctccagggaagcccaggccatggcatcagactgtgtgttttcatcatgaaactgaatctgtacggtatgctcatcctcctgaatcataacagggctgctgcataccgttacgtcatccggcagcttcagacgcagaacaggggcttttgcagcttcctgctccgggatatgctccgtggtatgctccgaagcagtcccttcctctgtttcaagctctgtctcatgccctgtttcatgcccggtcccatccccgttcccataccctgtttcagactctgttccggactctgaggccccgctcactgcggtctgctgtcctgctgacacagatgacgccgtctccttctgcgtacctgtaccgggcgagcacgcgccaagtccaaggcctgccgcagccgcggctgcggcaaaatataaaatgtatttcttttttctcatattgcagctcctttcaacctgtttgtactttcggctcatttatgagcttaacgcctttgtacctttaaaagccatgaatctgttcgttctgtgtatctacagaataccatatttttatattacatgcctcatttttttattcgtaaattactccttccgcccaaagaagtccttatgtcaaaaaagcctgcccgcaggcaccccgggcagacttaaacattcattaaacaaactctttcttattcatatataaaaccgctgagttcatagacacttacagttccgcagcacttcccttttatccgcataccaggacggtcaccgtaaacccttgtggtaaagacctccagcccttcatttacaaatatttccaaggaagtggtatctgaaaatatgcgcaggtccgtaagctgttccagtaaaacactgcgtcttgtcctgccgcttccgctggttcccatgtccagggtcagcaggccatcttcataggacaatgtgacatcatccctgatggtcaggcacatatcactgcaggactccatggataaacacgcctcgaacacaagtcctgtttccacacccttcccaagctcccaaaaatcataatcccttctgtcccggcgaagctccttcatttcctccagaggctgctgtaaaagacgtccttccctcatatgaagaaggcgcggcatggtaagggcatgctgccagccggcctttaccgtcggattggtatattctgcgtccggtatccccatccatcctatgagaatgcgccgcccctgctcgtccagaaaggtctgaggcgcataaaagtcaaaaccccggtccaccattccgggaaactgcgaattcagcctgatggtattttccctgaaatcatagtccagacaaaagaccgtacactgatgcacattctgatactctgttcccatgggctccaccccctgggggcagcagaccaggcagagccggccgtccagacagaataaatcagggcattcccacatatagccaaatgtttgttccgtcgtaattctattaaaatactcccaatttgttaaatccattgaccggtacacaaggaccattcccttgctcagggcatccctggcccccagtaccatatagtaatactcccctttttttaagaccttggggtcccttatgtgacagctcatgtcagccggataatccttgtggttcatgaccagttccttggcagaaaaatgatatccgtccctgcttgtaacatgaatggtattactcacccggccgctcataatataatcataatcatccctgtcaaacagctttacattgcctgtgtaaaaatagtggatggtcttatcctccacataagcagaaccggaatatacgccatgggcatccaggtcctggtccggaaaaagcgccggctcctcctgtttataatgaatgaaatcccgtgtggtatagtgaccccagagcttaatctcccctgtgggctcaaagggtgtatactgataataaatatggtacagtccctgaaactggcagagcccattggggtcgttcagccagccggtttccggcatcaggtggtaggccaggcggctttcatccgccctgaccctttccctgtaatcccggttgtcccggtaccatgcttcatagtcctccctgcggaccttctcatatttcttcaaactgcttcctcctcaccactgctttcttcaggctgcttccttctcaccactgctgtcttcaggctgctttctctctacccgcgcagcatgtttatgccgtcttaactgtcttaactgccttcaccgccaggtccccgctgtctgcctgtccgccaggatatacggtcacatccagatttccgccctcaggcagaatcatcatagtctgcggattcaatcccttttcccgaatcaaatccaggtcagcggcaataagcttatggcccttctttaccttatccccctgtgccacaaaggcctcaaatccctgcccatccagctgtactgtattgattccgatatgaatgagcacttccacgcctgtctcagatgtaattcccaccgcatgctttgttggaaacagcaggcttatggtgccgtcgcacggcgcgcataccatgccctcagccggattgatggccacgccgtcccccagggccttggatgcaaaaacctcatctgcggactgtcccacatccaggacctgccctttcatggggacataaagttcagtgatgatttcccgggtccgctctatttcctgtggcatttcgatttttcgggatatttccatgtccgaggctgtttccgttccctcagccctgcccgcatcctttttctccgggccgtcctccctgccaagagcaaactttttccagaacaccatggtaagggcaaaggaaacgcccatggacaaaatgattccaatggcaaaattcatatagtggtcaggcttcatggagataaagcccggaagtcctgccgcgcccaatgcctgagccagtgtcttggtggctgccagataagcgcttcctgccgctgatccggccatagctgcatagaatggatacttcagtttcaatgtcacaccaaacatggctggttccgtaatgcctaacagggcagaaataccggatgcagagcagatggatttcattttgtcattctttgtcataagaagcactgccaggaccgcggcgccctgggcaacattgttcatgctggcagttgagaaaatgaagcttccgcctgtatgggcgctgtcagccagcagctgtgtctcaatggcaataaagctgtggtgcattccggtcatggtaataggagcatatgcaaatccaaagagtgctccgcccacaggtcccagagtattatagagccatgtgatgcctgaggccagcagattgccggcttccctcagcacaggtcccacgcagataaaggtcaggaaagaagttaccaggatggacaaaagaggggttgtcagattatccagccaggacggcgttaccttgtgaagccgtttctcgatattggccagaatccaggagacggccagaacaggaagaaccgttccctgatatccgatggcagctatctgaaaaccaaagatgtcccatacaggaggctgtgccagaccaatctggtatgcgttcagcaaatccggatggaccataatcatgcccatggccgcccctaaaaacgcatttcctccaaactttctggtagcgctgaatccaatcagtaccggcagaaaggtaaagggtgcgtttgcaaaggtgttgatggccgaagccagtccctgccacatggggtacagctcaatcattgactgtccgtttacaagcggggacgtcaaaaggttgttaagtcccataagaagaccgcctgccacaatagcgggaatgatgggcacgaatatgtcactgagcatcttgatgaaacgctgaaccacatttcccttcccctcttctttttcctccggcttttcctccagtgttcccagctgcttctgtacttcatcgcagaccatattcacaataccggaaccaaatataatctggaactgggattgtgtgagaaacactccctttaccccttccaggtcactgattgcctcctcgtttcgcagcccgttatccctgagctggaaacgaagtctggtggcacaatgggtaactgaattaatattgttttttccgcctacgtacttgatgaccagacttgccgtctttgcataatccatcatattccttcccctcttcttactatgatttcccttcgctttttggtatcggttccataactatataatagggtattcagcctataatgtcaatatttcattggcaccggttccatttttgagcgtaaaaaaattccctctaaatttgtgcacttttcacatatcttcttccatttctccctgtatgctcaaaaatcactttgttctttgacgctgtggccttctatcattgtgtaatccactatctgtttttttggcaccggttcccgatgtatcatcttaagtatggtttcagcccccagataacccagaccgtaagaatcaaaacgcagggtggtcaggtccggctttaacagagtgctttcatcatatccgccaaatcctgccacggaaacatcctccggaatccttaatcctctctcccccaaaacatgatacgcgccaaaagccaggcggtccgtggcacatatgattgcatctaccggaccctggtccagaatttcctcagccatgcgaattccgctggcatagctgtaatccccggcggccgtgaccacatccttaatgccccattctttcaggccgtccatcacgccctgcttgcggttgatacccacggccacatccagtgcggacactcccatatacccaacccgggccggacgggcctttgccacacggactcccatggcctttcctgccccgtaatcatcgtggacaatggaaattcccccgtcatagtcctgtgccagcaccaccactggcacagggcttccctgtatcagcttacggtgcgcctctgttatggtaatggcgctcaggatgatgccgtccaccttcagtgtaatcagtctctgaatattcttaagctccaggtccacactgtggtccgaatccttaatcagcgtttcatacccctgttccctcaggtagcgtccgatgctggtcaccacacggctggacacctttgaattcagggtgggaaggaccactccaatcacattactttccttggcctttaacctggcaaatgtattgggttcataattatactcccttatgatttcctgtatccgttccctggtggactctcttacactgcctccgttaaaatatctggacactgtactcttggtaacccctgccatattggcaatatcatccatggtaatctttcctgatgacatatccatcccttcactttcatttgctgtgattatactgattgcagcggaagcacaacagacgcagactcccagtacgccctgtaaagcggatattgacagctgcgtctgcttccctgttatctcttgtgtattagtatatcaaaaccgcggcgttctgtcctctattatcagaaaataactgcactgtgccagattaccccggtctgttttcatatcaaatctcagacaatctggcttccgaagggcatcagggccagtttcgccagcttgaactgctgcagcccaaagggtatgcccacgatggtaatacaaagcagtactccgatgatggctgactcaatggccaggggcaaaccggaaaccagcagccagataatattcagaagcagggaggccgctcccccgccgtagaccacttcctttccaaagggaaagaaactcaggcctgcaaacttaaagcactgcagtcccaccggtattcctatgatcgttatgcaccacaggcagcctgtcaggagccatgataagccgcttatacatccgccgaatataaaccataatacatttccaagacatcccatataccttaccttccttcctgttctgtttccagtgtctgcctcatctcctggagacgtttcctgatactgctcacctggcgtctggcttccctgacctggttcagggcatcccctattttagactgcaccatccagtcagctatgacaccgtcaaaaaagtaatcggcaaaggtaagaaaacttcccacatccatctttaaatccccggtcaggtttacatccagcaattctctctttaatctgcgcagatgtccccttgcctcattcatggctgcctgggcctcatccatccggttatgcttaaacatggtgctgaaaaatccgccgcccagcatatcccagattccccaactgcttgccttctgtagcagttcctccgccttttgcaggctcatggaagccatatctgctgccattaatgcctcactgatttcctgttgtctgctttttctctccattcttttctcctttctgcgataaacaataccttgatgttgtgcgaggcaggtattaccgccagctttgcatagagaaaaaaagacctttatggtggctggctccctgccacaataaaagtcttgcacatttcattttatacgggtgcctccggcaccgagatgacgatttaaaatccaccttctggtggttcgctactcccttttattggaactgattatagcatgctgtatgatgaatgtcaaatacgatatgctgaagaatctattacatttttcttatctgtcttcttatctgttttcttagctgccttctcagctgccttcttccgtcagtgcattacaattgttttccttgatgcactcccaagtcgtcgttccaaagcaaatgaatgtgtgatataatttactaaatcaaatcggaaacagaggaggtcaaaaagtgaaaacaattgggctgattggcggaatgagttgggaaagtacagtttcatactaccagattataaataaggaagttaaaagacggcttggcggacttcattctgcaaaggttattctttacagtgtggaatttgacgagatcgaaaaatgtcagtcagacggcgactggaaaaagagtggtgacatactgggaaaggcagctaaaagcatagaagctgcaggtgcggacttcattctgatctgcacaaatacaatgcacaaggtagttcctcaaatcgaatccatgatacagattccgattatacatatagcggacgccaccgcacaagagcttctggcatgtcagattcggaaagtgggcttgttgggcacaaaatatacgatgacacaagatttttataagcagaggttaattgacagaggtatagacgttattaccccggatgccgcggatattgatactgtgaatgatattatcttccatgaactctgcgtaggtaatatccgggaagaatcccgcagacaattccagagagtcattgataatttaaaggcaaagggagcccatggcgttatccttggctgtactgaaatcgggcttcttatacatcagaccgattcttcgctgcctgtttttgataccaccgtgatacacgcaaaacaggccgttgaactggcattagaggtttagtttcctttatttaaaattaaatctgatggtttagacaatgaagcaaaccggcaaagcggaggatataaaacaatggacaactggtttacaatagataaaacagactcaaatacctacattatcagtgaataccggcattgggaggaaacgcactgctatttgctgaacggaagggaacgaagcttgcttattgacacaggacttggtatttcaaacatatttgatgaggtcgtaaaactcacggacaagcccattacggcagttgcaacgcatattcattgggatcatattggaggacacaaatattttccggatttttacgctcatgctgaagagttggactggctgaatggcaagttccctttatccatagaaacaattaaagagatggttgttgaccgctgcaatttacctgacggctttgatgtaaacgattatgagttttttcagggggtgccgtcaaaggttctgactgatcatgatataattgaccttggcgggagacaggttgaagtgtttcatacgccgggacattcaccgggacatttgtgtttttgggagaaagataccgggtatttatttacaggcgatttggtttacaaggatatactctttgcctattatccatctaccgacccggaggcatatcttaattcactaaaaaagatttcttccctgccggtaaagaaagtatttcctgcccatcattcactggatatacagccggaaatcttatttcgtatgcgaaaagcatttgagcagcttgaagcagacggaaaacttcatcatggcagcggcacatttaactatggcgactggggagtatggttataaatctcccccagccgtgttgtaacttcccatgccacataatcaacggcgctgcctcacagagcgcaaatctatacatcttcccatatacaacaaatgcgaatggcctaagccattcgcaagtttcataattagtatatacagaaaaatctctattccatgtactctcttcaatggagcatacgggattcgaacccgtgacctccacactgccagtgtggcgcgctcccagctgcgctaatgccccgacactcgtagataataccataaatccgcaggaaaatcaagtactatttttccaattattcatacttattgaaaattcgtaaataaaaactcatctttcccacttttaatccttaaggaattttattcttaatttagctcctgctcaaacttttgtcacaatttccatgtatactcttatccataacaaggaattactccttttgatatagatttctctcatacttagccggcatggttccttcatgccggctcctctcatattcagacatttgccacttatctttcacctgaagcatccgaagaatactgttttttcctttatccccttattaacggcattttcacacattttctctgccagcatattatacgttagaagccagacaagcttctataaataaatccagaaaggatgtgtattatatggcttatccaaaagttcatattgtcaactctacgaatttcagtgtaaaagggaaggtgaaatatgcatctgccttttgttctgatgataactatgagatagctccatgggggagctggaccgccggcagccgaggggtctgccttcttacagaagtgtcggctgctgtccacaccccaggccaggattccaaagcaactccctatgaatcttccggaacatcctacagtcaatttgccgtactgcagacagctcccggaaaattcaccatgacccgtattgtgacctaagtcaaatgccggcgcggcccacaccgtgccggcccccaattatctgctgtaaatacaaagatgattttgtactgtttcttctgccatcaataacaataactgtgatatctggttctcagatattctcccctgccctgtctgcctcctgactgccagaccacattgcccggcaggatgctcccattttccagaagccactttgcattggcccaattgcttgctgtgggttcacggtaataatttccgtctctggtgcaggagtactgccccggtgcaaataccacgcctttgatggtgttgggaaaccggccatggttcacccgattcaacaccactgagcccaccaaaagctgctcatcatccggacagttctgcgcctctccacagattacatgggccagaatataaaggtcctcttctgaataagaagggcgccttatctcaatgcctgagagatattttgtttctatatatgcatgtcctgcctctgttgttatcatggaccaatcaccatattcacccaaaacctcaaaggatgtattcagaaatgcctggtccaaaaccaccgcccctgtgctgggttccttataaatattgattccatcctggttagcaaacttaattgtcttatgggcagcctcctgaagagcggttttgaattcacccgccacgctcttggcggcgagtaccatatctgtcccgttttcctctgcctgcactgtcatgggcactgccagtgataaggtcagagccatggcccccaatataacgattcgtttcatatctactccttaaaatgtttgaactgcctgagccggttacttgccaactgcccatggtaatggttctctattatattctgtcccaaaattagcaatccaaacatatttaaggtaatgaatggcaaaaaagggccgccaccatgtgacggcccggcctattcgcgtatcagccaccggcctgcttcccgcaataatatatctcttttattctccatgactccttctaccacctggtccgccagcttagacagcgtgcttccaatggagcttcccggtgtataaccaatctgtatcaaatcacttccattaatatccaaatccttaatatgaaactgcccggtctgctccaccacctcatccagaagggcttccaaacgatggattctggccagccgttctgccagacaggcaggattctggccgcttacatcacaccggcgtacctccagcagccgccggaactgtttttctcccagacggtccagccatgtcctgatgctccgtctcttttcatgaaggtcagagtcgtggtatcttaccaactccaccaccgtatcaatggtttcttcatcgaatttcagccgtttcattacctgtttcgtaatcctggcgcttacagggccatgtccatagaaatgccctctgccgtcctcatcctcagtatagcattccggttttccgatatcatgaaacagtatggtcaatgccacaacaggatcatctcctgccgctctgagggccgctgcggtatgctgccacacatcgtagacatgataaggattattctgttgaaatccgcacatggtccttaattcgggaaccacagtaaacaggatatgctgccagttgtccatttccaggttctggccttgtgtaaactcccatcctcttaattccaattcccttataatgcaggccgcggatattggtatatcatgattacaattcaccttttaccaccctctcatttacactggctacaaagtcattgatctttctgatatccggttcttccggcagcgatgtgttcttccgggcataatccagacgcttctcatattcatctaccatctcaaaaaattccggaacaggcagctggttctcatccagataccggccatttctgatatccataagaaggtcgtgttccttttcacggtaagtcacaatctgttccttttccagaatatccaggcacatcatgtacaggcggatcagatgcatcatatgcttacccagtttaccatgctctatggcattctggtttctctttcccaccttttcatatgattttacaatgctctgcatctctgaccacaggcatttataatccctgagcggataatgcctcagggtaatgtccataaatatctcactatcatattcttccttaagagcttttccaatatacagattaacactgtccccgggcatataaaaataccggttcttccagtcaaaggaagcatgttctatggttttcagtatatgtctctcattatccgtctgttccacaagccgggccgccttgttatccagtctgcgcagctgctggtttgcatatcctccaaaagaataaaccgctctctgggataagaataagtgggcatggtctaacagctccctgcccactggcgctatatgcaaataatggtcttctctgccgcccagcatttctatggtatttggattacaattggtcagcaggggaatcagcttgcggaatgcatagatagtggtatcggtgtgcggatccgttacctgcccaaaatcctcatgaatcaggatttccctcttgctgttcagggcacatccgcgaatatccagatcgctggtttccatgctggttccataggcatggcttcctcccagtgtcaataggatgatgtgatggcccaggtgttcatccgttcttaagaaatcatattcactggactgcagcctttcttttatttgtcctaaggtcatacaatactcctttttcagtatcatttatgccattatagcaggactggtggatgaaagcaaaccaattaggacctgtttgcaaaagatacgtgcacacagataagaattattagaaatttgattacggttaaaagcgaaacgaatacccgcaccggcacccaatctctcctgtattataaagctcgcccttcaggcgctttatatgagccttttttccacatagcggacatacaaaatccgcctccccatagccaccggtgctctgcaatgcctgcagggatgcccttatgaaacaatataaattttcaatggtcatctcctgttccaggttgattccgcaacactcctccattcgtatacctcctgcctgttttatcatgatgccggggatttgcttaaccctcattggctcctgcggcagctgccggcctgcggcgccatgccctgcggtgccatgccctacggcgcattcacctccagaagccgcgcctcaggaataccctttttgagaatactgctacgtaaatgcatgctgtaatcctgacggcagcggagcagattcctttgaaaaatccaggaaggatacgctgtaaaacccgttctcttccccgtctgcggcctgagccttatgccagatatccagcgccttctgaaccgttatttctatatcatgataataatagaggttagcgctggtatgggtcacaacgtccgcaatcaaaagtctggcatcatggttctcaaataaaacttcattcagattgtcctttgtgattttcatgtggctgcctcctgtcttatataggtttttataggttctggcttgatagattcaacagactctgtatagttagtctatcttcttgaatctgccaaaagaacatatgttcttttatatattatatgatatcacaaacgtatgttcgtgtcaaggtataatacagcactcatcgcttgcaggaatgtccctgttaaaccatgaatcaatcatacatggccaaccttgcacatatattgtaaaaacatatcataagaggcttttatgcaaaccataacccagcatattctgacagaccagatggattaccaggacaccgttgtgcttaactgccagattcgttacccacaattgaacgcttcctgcaatcaggaagcgatacaggccataaaccaatactatgtcacacaggcaaatgataaagcaaggtactgccgcagcgtattatatccccaggcggccgaggaggcaaattacagccgtgtccgcaatgttccattttttccatatgaatttaatataagctatgtggtgacatataaccaggactgtattttcagtcttttttcggaacagtatacctttacaggcggggctcacggatccaccctgcggacatctgagacctgggatgcccaatccggcagaaaaatgacgctcagcgacttttatcaaaacaatccgtcttatattcaggatatacagaattggatacagtttgagattgcagagaggctgaaagccaatcccggtacctattttgacaactaccaggaactcctgcgaaattccttccatccggagaatttttatttgacaccaggcgggatcgtcatttactaccaacagtatgatattgccccttattccagcggcataccggaattcctgctgccctttgatgcagatacttctaatgtataacgaatccctcatcatccaaatgggagtaccgccatgatgacgatacccccattttttattttccctgtattttccttatctgcctttctgactctcacaggtcccgcgttctctgccccgctgcggctgcatccgaccctatttcatcagcaggcaaggctcccgccgaatccggcgcctctctaactgctcacagcttcaaatctcatacgctgtctgatttccggatacttttccctgtccacctcagaaaaaaacatttcagccggcctggcaaaggttccaaactccccgtacagcgcctgatagatgaccaggagctctcctgtctccgtatgatgggccatgtccctgaccacatagagatatcggttcgtctttttttcctccgccgataatgtttccctcttaaaatgtctgacaattgtgccaggtccgattcccgtgtgttcattctgtctgttcatccttattcccctgtcctgtattattttgttctccctttggattaaataccataccggaagctacccgttcattcaaggacttatctctttttactgcaatctcctgtcaaatcatagctttcacctatcatccgtttgatatcctcatccgggacactcccatccaaaaccaccgtattccagtgctttttattcaaatgataccccggccgcacaccggaataggccttgcgccaaaattcaatccattggggcgcgcatttcagattaatgcagacctgtccctcccgccgatatatccaggcaaatacccgcttattgccccggtggcgtatgacagtccattcatggtccctgaagggatagtcctcatatacatctttataggtaagacaatatgtaattaaatcgctctttgtctccatccgccctcactcctttatcaatcacaccatggttatatcccattctccgcttcattccccaaaacagacagtccctcatggagccagccttatcatcctgcattataccagatttatcttcataaaaccatcccataaaacacggttcagataatgtgcagataatgttatggaatcatgcccgagacagcatccgaaataacgtttggaataatacctgcataaaaccatggagcgtgccggaggactgtttcctccgtctccacgctccaggccgcattttttgcttaataccaccgcaccatgggcagttcattgtttacacccttgctcaccagtatctgatgaaggtcaatgactccattgtggaatgttgccgcgcaggagcacaaatacaaatcccacatgcggacaaattcctcgtcgaacatgtcctttatctccttttcatgttccttgaaattcctttcccagcacagcaatgtcttgttgtaatggtttctcaggttctccacatccaaaatatgaaagtcatgttccgccatcagggatataatttccctgagacttggaatgaccccgcccggaaatatatatttctttatccatggatcccctgcgtgctctttctggctgctgataaaatggagcaggaatacgccgcccggattcagcaccttgtccacacagtccatgaacctgccgtaattttcccttcccacatgctccaccatacccacgctgaccacacggtcaaatttcataccgctttggggtaaatccctgtagtccatgagccggacatccagcagatgttccagcctttcctcctcaatgcgctttttaaagccgtcatactgctccgtactgagagtgatgccggttcccctgacaccgtattccctggccgccctgattagcagaaatccccatccgcagcccacatccagaaggctcatgccctcttccagcgccagcttcttcagaatataatctgttttattcacctgggcctcatagagagtatcattttctgtcttaaaataaccgcaggaatagttcatggtttcgtccagccaaagcctgtaaaaatcattgccgatatcgtagtgggaggacacctccatcttctggtttttcctggaattagagggatgaaggagctttctcagatgcaggcggttgacggaaaaacggtccatctgccccaggaaatggtccagggcctcatacagactcccctccacctccagcttgcccttcatataggcttcccctaatgccagggaggtgctgtccatcagcttcttcaccggtatggtttccctgatgtcaacggcgaacatggggttgccgtgacctatccggtcttcgtggtccttccattttaccagaaagggataatctgtaaatcggttcataaattgaaccattgccttctcttctaacatactggtatcacacatcctttcttccagtattatccccttctggaaatagaatattcgcagcacggtccaaactgttgcaaatacacacataaaaccccggagagcctaagccctccggggtccatcatttataacatattcaaatctgacgtaagattagtcgttgccgtacagtgtaaccagcttctctaagtaagcgtaacgctccttagcctctgcctcgttacgtgcgaacagctcggctgctctctcaggattcttcatagccagggacatgtaacgaacctcgccctttaagaagtcctgataggtctcaagcttaggagccttggaatccagggagaacttcttctcagctgccgggttgtaacggaagttgttccagtaaccgcactctacagccagcttctcctctgtctgagccttgtccatacccttcttgataccatggttgatacatggagcgtatgcaataatcagggatggtcccggataagcctctgcctcggcaattgccttaacagtctgagccatatcagcgcccatacaaatctgtgcaacatacacatagccgtagctcatggcaatgcttgcaaggtctttcttcttaacgtccttgccgcctgcagcgaactgtgcaacagcacctgtcttggtagccttggaggactggccgcctgtgttggagtaaacctcggtatcgtataccatgatgttgatgtccttgccggatgccagcacgtggtctacgccgccgaaaccgatatcgtaagcccatccgtcaccgccgaatacccactgggacttcttagccaggaaatctttattcttaacaatgtctctgcagacatcgcagtcaacgccgtccagaactgcaaccagcttatcggtagcagtgccgttcagagcgccgatgccaaatgtatcaagccactccttgcaggctgccttcatctcgtcagtagccttctcgttagccattacgctctcaaccttagcctttaagccgtctctgattgcgttctgagccagcagcataccgtaaccaaactcagcgttatcctcaaacagggagttgtcccatgcaggaccctgtcccttggcatttacggtgtaaggtgtggaaggtgaggagttgccccagatggaggaacatcctgttgcgttggcaatatacatcctgtcgccaaacagctgggtaatcagttttgcataaggagtctcgccgcatcctgcgcaagcgccggagaattcaagcagaggctgtctgaactggctgcccttaacggtgttctctttgaacttagccagaacctcttccttaacaggcagggactgaccaaagtcaaagatagcctgctcgccaaggttagcctcaaggctttccataaccagagccttgttgcccttcatgcctgggcatacatttgcacaggaaccgcatccggtacaatccagagcggaaacagagatagcgaacttatagccggccatgcctgtcatatccttcatcttcatgtctgcaggtgcctttgcagcctcgtcagcagtcatggcaaccggacggataacggcgtgaggacatacatatgcgcagaagttacactggatacagttgtccggattccatacaggaaccttaacagcgataccgcgcttctcatatgcggaggaaccggatggtgtggaaccatctgcatactctgtaaatgcggatacaggcagggagtttccttcctgagcacttacctttgtctggatattgttaacgaagtcaactacatcctttcttccctgggttacaactgcatagtcaagaccttcgtcttcacagttcttccagctctccggaacctctaccttgtgcatgcccttagcgcctgcgtcgatagctgcccagttcttctgaacaacgtcctctcccttacggccgtaggttgcctttgcagcagccttcattaactcgtttgccttctcagcaggaatgatgccggtcagctcaaagaatgcggactgaaggatggtgttgatacgtgttgggcccatgcctgtctcaataccaatctttacaccgtcgatggtgtagaagttgatgttgtggtcagcgatgaacttcttaacctgtccaggaagatgcttctcaagtccttccatatcccatgggcagtttaacaggaatgtaccgccgtcaaccagctcctgaaccatgttgtacttgcgtacatatgcaggattgtggcaggcaacgaagttagctgtacggattaaataggtagacttgattgggctgtgtccgaaacgcaggtgggacatggtaacgccgcctgatttcttggagtcataatcaaagtatgcctgtgcatacatgtctgtattgtcaccgatgatcttgatggagttcttgtttgcaccaaccgtaccgtcagcgcccagaccccagaacttacagtttgtggttccctcaggagtggtaaccaaaggagcgccaatctctaaggacaggtttgtaacgtcatccacgatacctacggtaaatggagacttggttgtattctcgtaaactgccacgatctgagcaggtgtggtatccttggaacctaagccgtaacgtccggttaaaaccttaacctggtcaaacttgcttcccttaagggcagcaacaacatccaggtacagaggctcgccgatagcgcctggctcttttgttctgtctaatacggagataaccttaacggtatcaggaatggcgtcaatcagggcctgtacgcagaatggtctgtacagacgaaccttaacaacaccaaccttctgtccctgcttcaccatgtagtcgatggtctcttcgatggtgtcattgacagagcccatggagatgatgatgtgctcagcatcagcagcgccgtagtagttgaacagcttatagtcagtaccaatcttggcattaaccttgtccatatattcctgaacaattgcaggaagagcgtcatagtatgggttgcaggcttctcttgcctggaagaagatatcagggttctgagcagagcctctctggcatggatgatttggattcagtgcatgcttgcggaaagcatcaacagcgtccatgtcaaccatttccttaaggtcctcataatcccaggtctcaatcttctgaatctcatgggatgtacggaaaccgtcgaagaagttgatgaatggaaccttgcccttgatggatgccatatgtgcaacaactgtcaggtccattacttcctgtacactggactcgcacagcatagcgcatccggtctgacggcatgcgtaaacgtcggaatggtcaccgaaaatagataatgcatggctagcaagagcacgtgcggatacgttgaatacacctggaagctgctcgcccgcgattttataaagattagggatcatcagtaacagaccctgtgacgctgtgtaggtggtggtcagagcacctgctgccagagaaccgtgtacagcacctgctgcaccagcctcagactgcatctctgtaatctgtacttcacgaccgaagatattggttcttccgtctgttgcccattcgtctgtggcttcagccataggtgaggatggggtaatcggatagatagccgctacatcagtaaatgcgtatgacgcatgcgctgctgcatggttgccatccatggttttcatttttcttgccattttgatttcctcctacaaatagtgaatatgtaatggtatacatgtgagtctgccccggacccgggcatgtacaaacatgcttcgaccctatgcagactgacctgtctactattatagcaattatttaacaaattgcaaatgcttaatcgtaattacgccaaaaaatacaatgtcaatttttgaaaacctgaaaagcgccgcaaaaaaagagaaaccattgatgccggtttctcttttcctgtctgctttttttattctggtttcagcggcgcaatcaccggattatccccgcccggtcctgctgcctcagtctcagacggctgcggggcctgggttggattcggtgccgctgcaggcgctgtggttggcgctgccggctgggtcactgtgccgggaccgctctccggggagccgtttccggaaggcgtggtgattgtctcatcacccggaatatagccgtccggcattccgtcaatggttggcgttgttgtctctgtggaaagggttgtctcctcaggcggcagcaccacgcccgtggtgttgcggcggataacgggggcatggcctttgtatgtggtcttatggtcctgctccctggaaacctcttttccgtccttatataataccttgtaggtgatccatctgcttcccttgctgccggcgctcttctgaatctccactcccggctcaagggtctggtcctcctcatatgtaggtgccggcggatccagctcctccactttctcggataccaaatccagctttgttccctcctccagaatcggaataccgtaaatggataccgtcatcttctggtccgcgtagctggccttgatgccgatggatgtgctggatgtgttcttgaagcggaaatccggctgttcccagctcaccgtggcgtcctggcccggtgtgatatagttgggctcaaaggtgtgggagcgcctgaaggtaatgctctcctctcccagcccggacctgtatactgcgttgtacagggtggtggatacctggcatacacctccgccgatctcctgtaccacctctccgttgttataggcggctgctccctggtagccctttgcctctgtcctctgccccacggctgcgttaaaggagaattcctctcccggatgcaccacggttccgttcagagcctctgaagccagcctgatattggtatttcgggccttgttggctgttgtctttgtggtgaaggtgctgatggtcttatatttttccttggcagcggcagcgctgatatccggggctgtctcacttcccgtggctgtgatggaagcgtcaaacttcttatctttcagggcctttaatatgtctgctgccagcttttcctggtcaatggcaaacccattctcttccccggcgaacacaaaagcgcctttttccttgtcgtagctgtcgatggaaccgtttttggcctttttattccatttggccgcgcagttttccgcctcccccgcagccgcctcttccagtccgtccatgttcagtgtgtaactctcagccggttccccgctgtagatttcatccagcagcgcgtctaccttttccgccgcaagattcgtcacattatatgtatctccgtcataggtaactgtcatattccagggatattccttaagaattgcattcctggcctggtttttggacataccagtgatggtgatcccatccaccttgacttccttcatcatctctgtctcggttgtctcttccaccgaatgatccggttcgcttccaccggctcccttccatttcatggccagcgatatgccggctatgaggataataagaataactccggctatggcaatctttttataatccggccccttctttctcctgtgagggctgttgcgcctggctgtctgggccgcgttcatcctgccggcctgtccgccggaacggtaggaataagaacttcttgaaccgctgcctgacgaactgcttctgcctgtattcctggacgttccccgtcccgtacctttatctgaacccctgccgcggcttctgcctgctgaggaacttcttctgttctgattattctctaactgattcattctattcacctgtcatctctgcctatagatttattcacaagttgtagtataacatactttatgtaaaatggaaccgtcttttttgtttttttcaggccaattttacttattgtgaatttcatgttactatatataaagtaagtattattaaattattaaaaatcaattacaagccttttcaaggtctttacatcttacgattcggaggtcacatcatgtcttacgttgatttacatgtccactcaaatgcatccgacggcaccctgtcacctgagcaggtggtccgcctggcccatgaggccgggctttcagccatcgcccttacggaccacgataccacggccggtgttgccggcgccgcggaggccggggcagaactgggtctggaggtggtgcccggcatcgaggtgtccagcagtttcagggaccacgaaatccatatactgggacttttcgtggatacagattcgccttcccttcaggctgcgttaaaggaattccgccaacacagagaccagcgcaaccaggagatgctggggcgttttgatgcccacggcatccacctgaccgccgaagatttgtgcgccgggaaccctgatacggtcatcaccagggcccatgtggcaagagcccttctggcaaagggtctggggcctgatttggaccatatttttaagaaatatctgcaatacggaggcatatactgcccgcccaaggaattcctgccccctgaggcggtcatggaagccctgttagacagccatgcctttgtggccctggcccaccctttccagtacaagctgggggataaggccacggaggagctcatcgcctatctggccggcctgggtatgaaaggcctggaggtatatcactcctcccacaaccgcctggaaagcgccaagcttcaggaaatggcggcgcgccaccatctgctctccacaggcggttccgacttccacggcagcaataaaccagatatttccataggaacagggcggggcggtctgcgggtctcctccctgctgttagatgcgataaaaaacaccctttaatccctgtatttttatgaaaaatcataattgcccttcccccgcccttctgctataatcatatatgttaaaaaattaaccagccttttccatttcaggaaaatgcatacaaacacaggaggatatgccatgaagattcagaatatcacagacgtagaaaagtttttctctgtcattgaccagtgcaggggaaccgtggagcttgtatctccggaaggagaccgcatcaatctgaaatccaaattagcccagtatctgtctatggccaccatcttctccaacggatatatcaaggaattagacctggttgctcatgagaaggaagacatcgagcgtttaatcaaatatatgtatcagggagaataagcctaagataaaaagcctgggataacagccgggaatacagacaaaggcaaagcccggaaccatttgacaggttccgggcttttttgttatctctgttttgttgtctctgttttgttatctctgttttgtagtattcacccgatgattctctcgtacaatttccgggctttactcctgctgcccctggtccccgtctttctcaccaaccggtccgcaggcatcctcacagacagctgttcctccgcccttctttcccaggcgggtattgaccccgtcccgtaagagggcatacagtacggaacacagcggaatgaatatgagcattcccacaatccccatcatgctaccgcccacggtcacggccaccagcacccatatggaaggaagccccaccgaatttcccaccacataaggatatatcaggtttccctctatctgctgcagtacaaagaaggtaatcgtaaaaatcagtgcatccatgggatttaccatgagcatcaaaaacacgcccactgccagtcccacaaacgctccgaaaataggaatcagggccgtaaatgcaatcagcaccccaatcagcagtgcatagggcaggcgtataacggtcagtaccacaaaaaacatggttcccagaatcacagcctccgcgcactgtcctgtaagaaaatgggagaaggtgcgctctgtaagggccgttatatccagaatccgccctacagccggttccggcaaaaatgccgccagcaccttctttatctgccgtcccagtgtctccttctgcaaaagtatatagatggcaaagataaatccaatgaggaatgaggacacgccgctgacaatggagacagctgccgaaaaggtggtgttaagcatggttccggctccgctctttaaaaatgcaaccatgttctgaaacacttcctgccagtccacttccatctggttcatgtattccagtatctggggattgctggcaaatatacgctccgcctcatcccgcacccctgcaaagaataccgggatactgctttgaagattcataaaggtctttaccagctggggcgccaccacaaagatgaccagaaacagaccgcctgtaaccaggaggatggtcaccaccaggctgacaggccgtctcagcctgctgccctccccaaacacggtcaaatgcctctcgatattgcgcatgggcacgttcagtatgaacgctatggctgcccccagaataaagggccagacaatatgcatcaatccggccgccacatccaccagacgtctgtaattgattcctgcaaccacaattaccacggtaaaaacgataagtcctctgatttttttcattgtatcgctgtttaattccatcgtaccatcctttatagttctgtctcttccaggaacgctgcctcaatggcttcccgcgctgcccggaaggtgccctgggccataaggctgctgcctccgccccttccgctcagacggctgttcatggctttgctgagcgcgcgcatgtccatccggctgctgccaagagcatagtgatattcgctgtccctgtcatttccggaacacacagcagccaccccggccttgttctgttcatagagaagggtcgcatactggcggacctgaatcggagttaaatcctcctcaaatacaatgaggggagctgcgctttccgggaactgtcccgccttcagggccagcaggctgctgcccagcttcccaatcaggtaatccttgtcctggctgtcatttttaagcttttccactgcatccggcacctggaccagcttggctgacagcaggttggatatcctggcttcatccttcagcctgtccctgtaatccagaagggccctgcgtccgcacagcatggacagtcgaacgccgcccttgtaatgaatcatgcttcttatcttaatgatgcccacttctccggtattttctacatgtgtgccgcagcatgcgcatacatctgcgcccggcacctccacaatgcgcaccaaaccggacagttctttcttgcttctgtactccatggtcctgagttcttcctcggagggatagagcacctttacagggacattggcatagaccagctgattggcctcatcctccagccaatccagatcctccggctcaatgatgccgttaaagtccaccgtcacttcctcagcccccatgtgaaagcccacgttatcatatccaaagtgtttgtgcaccagaccggacagaatatgctccccggtgtgcagctgcatgttgtcataccgcctctgccagtctatgattccctccgccagggtcccctcctctatgggctgcgccagttcatggattacctgctcccccttctcatggacggacaccacggaaatcccgtttaaggttcctgtatcatagggctgtccccctccttcaggataaaaaccggtctggttcagagtcaccagccaggttcctttcccgctctcctcacagtgctccactgtacacatgaacgattttacataagggatctggtaatacaatctgcttttgtccattcttaaagcctcttttctttttcatctgccggaacgtatttttccttccattatcagaaaacggtccgcgcagtatcatgtctgccgacattatactatataacccggccttgtaccaacaaaaattttctaaattttatcaaattgtggaaacatgagcaagcagggcttcatatgatacagtgtaattaaactttatatggaggaattaacatgagtgatgtagcagcaacaaactgcggttgtgactgtggatgcggatgtggaacaggaggcagcggatgcggatgtaatatcatctggcttatcctgattctgtgctgctgtggaggcggcggtggcttcggacatagcgactgcggtggcggttgtggctgtgggtgcagctgtggaggcggatgcggagatatgatttggctcatcttaatcctgtgctgctgtggcggcggtggcggtggcttctgctgctaattcccacctctaagaaatccttcaccaaagaatcaaaggaacagggagtgcttcatcactccctgttttttcttgcagggaagccgggcttatttgccggcctcacctgtctctccggacgaaagaggacttttcgtaccccggttcttacctccgtacccctttcttccctgtctctgctttaagcattcctcatctatttcatatactgcatttccatctataatcaaacggctgtacatggatttcactctccttccatacttataatatatgcagtgtccaggctttggctcattgtgcctgaaaataagtggcatgtaacaggctcctcccgcataaattggaagcaaagaaagaaaaggctggtggaaatacatgaatccatctgatgactataaactaaccgacctggactatctcataggcgaccaccatctgcagatgattaaggcctccctgccctacctgggcgttcccgaacaaaaggccatctccctgtttgtcaaggtccaggaactgcgaaagacagtggagctctttgagactgaggaggtggcatccatgggtatctgctccctggaacgtccccagggaaacggctccctgcgcgatttgttaaaggccattcgtccatatggaaatcccatggagcaggatatgattgacatggccgaaaccctgatggaaggccagactcccatggaccagctgcgcaggttcctgacgccggagcagcaatcacgctttgagaccatggaaatgatattcactgccatgcaggccatggcctgatacggccggtcacagaatcacatcacagaaaggactacataattatggataacagctggaaacaagaccccaggctcaaggccatgaacaaagataaactggccatgctcactgaatttgcggagcggattgaacattcagacaaaaacaacatgatggaggcattcatggccatcaacatggaagcccggcaaaagggcgtacagtttaacgacagggagacagaccttctggtcaacatcctcagttccaggatgcctccctcagaaaaaaagaaaattgatttattaaaaatgctttcaaaaaaaatggcagggccgcgctgatggcgcccctgcctctgccttatggaattgttttaatagaattgttttatggaattagtttaaccgttccaaatccggtgcaatcacaatcttagtgtgctctgtggctgactgcaccagctccctggcccgttcctggggcaggcggatacagcccgcggatccgttatccctggcagcggtaaagcagtgaagaaaaatggcagagcccttcccgggctcgcatgcttcattgtaattcaatgccagggcgtaattgtagtacggagacgcagccgccatattctctgcggagttccaggtctttgcaacctggaatgtattcaccagcttgttataatagggactggctgaatcatccacccagtagtcgccttttgtgatcttatggtatggcaggacgctgcccggattttccctgagcccaaaagccatggtaaatccatatgtaccggagggcgtgctgccgtccccctctgtcttctggtccgtaattccgttccttcctacgatgcctgcttccttccagaccatctcccaggcttcacctgacttcttataataatatacatccgcgctacagccgccggttcccactaccaccaccagctggtccgcatcctttgctccttccagattctggggctgtatgaccccattctccactgcagccttcttttcctcagactctgcttttgaagcagcaggtacccccggcccctgttctgccggattcacggctgtccccgcagctgtccctgcgcctgcactgccggcagccatggccgtaataccgcccgccgccattatggctcctgacagaacaaacgctgccgctgccctgcctattttatgacacttcccattcatttccatcgttcttctttcatgtctcatggccgtcacctctatatcctgttttgtccatttcctattataacctgctatagcaggaaatgttatttcttttttcttacatttcccggtatggacacggccccaaagcccaacgcaaaaatgcctgcccagcccatgtgctgcaggctgcgcaggcattttgtcttcccgcttatatggggaaatctgatttatttacatacaatattgacaatctttccaggcacgtagatctccttcaccacattgcccgtcagcttttccttcacagcttcccgtcccgcggcaatggcatcttccttggagctgtctgcgctgatgctgataacggcccgtgtctttccgttaatctggacagccacctcgatctcatcgtccttcatggcctcctcatcgcattccggccactgtgcatggaacacgctgtcgtcaccgcctaactgctgccacagctcctctccgatatggggagcaaagggggccagaagaatcacgaaggtcttaagggtctccctgtcgattccgccttccttcctggccagctcaatcagcttattgttgtactccatgaaaccggaaataacagtattgaggctgaactggttgaaacggtattcaatgtcatataccagcttatggcgcagctttatcatttctttggacgccttcacatccttgtccttgttgtccatcaccaggttccagaaacggttcaggaaacgtgatacaccctcgatgccccggtcatcccactctgcgtccagctccggcggtcccacgaacagctcgtaaagccttaaggagtcgcagccgtaatccctcaccaaatcatcgggagaaaccacattgcccttggatttgctcatcttaatgccgttctttccggtaatcataccctggttgaacagcttcttgaaaggctcatcaaaatcaatagcgccgatatcgcacaggaacttggtgtagaaacgtgagtacagcagatggagcaccgcgtgttccacgccgccgatatacatatccaccggaagatacttgtccgccttttccctggataccaattcttccttgttgtggctgtccacatagcgcaggaagtaccaggaggaaccggcccactggggcatggtgtttgtctctctcttggcaggagcgccgcagacagggcaggtggtgttgacccattcgtcaatggcagccagaggtgactcgccggttcctgtgggctggtagctctccacctcaggaagctttaagggcagctggtcctcaggcacaggcacgcagccgcacttgggacaatggatgatggggataggctcaccccagtaacgctggcgtgagaatacccagtccctcagcttgtagttgaccgtcttgtggccaaagcccttttcctctatcatgtgaggcgcttcttttttaaggacagcggactccaggccgttccaatcaccggaattaatcataatgccgttggcctcggtatacgcctcggtcatgttctcaatttccttgccgtcctttgcgattacctgtacaatgggcagaccgaacttcctggcaaactcaaagtccctgtcgtcatgggcaggcacgcacatgatggcgccggtaccgtaatcagccagtacgtaatcagacagccagataggcgtctttgcaccgtttaacggattaactgcatagcttccggtaaacacgccggtcttttccttggcctgcatacggtccacattggaacgcatggaagaatcgaatatatatttttcaacggcctcccttgtctcatcggttgccagactcttggccagggcatgctccggcgccagcaccatgaaggtggctccgtaaagggtgtccggcctggtggtgtacacggtaatcttctcttcccgcccgtcaatggggaaatccacctctgcgccgtatgacttgccgatccagtcagtctgcatcttcttgaccttctcaggccagtccagcttatccaggtcatttaacagacgctctgcgtaagcagtaattttaagcatccactggcgcagattcttcttggtaactgtggtgccgcagcgctcgcagcatccgttgaccacttcctcgtttgccagtccggtcttacaggaaggacaccagttaatggggaattccttctcataagccaggcccttcttaaacatctggacaaagatccactgggtccatttataaaagtccgggtccgtggtattcacttccatatcccagtcataaattgccgcaatctgcttgatctggcgcttgatattcctgatgttcgcctctgtggacttagccgggtgcacgcccatcttgatagcgtagttctcagccggaaggccgaaggcatcccatcccatgggatgaatgacatacttgccctttaacagctgataccggctccagacatctgaaatcacatatcctctccagtgtcctacgtgaaggccgctgcctgaggggtatggaaacatatccagacagtaatacttttccttcctgccatcgttcacattgatgggcttctcttcccagttctcacgccactttttctcaatggcgctgtggttgtactgtgttgccataatctcattcctccattggttatctaaggggatgattcccctttatccagacagcatacctgctgcgcgcagttttctgtgaaacaaaaaagccctgcgcctctactgctagagacgcaaggcttaaaaatccccgcgcggtaccactctggttcatgctgtctgacgcatgcacttaatcctcttataacggtaaggtctccgtcctgtcctactggttcccggtcccccgtttccggcggtccttcctcgttggggcaggctactccagggccagttcaacaaccatccgtcaccggctttcaccagccgccggctctctgcatccatccggttatctactcttccctatctgcgtatttgcactgattcttaatttaacatatttcccaaacagtgtcaactgttaccagacaaaaaatcctctgccgcgatctctgaccaggccgccttataggctgtcttggagcgttttgtctccctggaccgtctcaccggtctggctgccctggcccatttggccggcgtctcatggcgtgagggctttgccggtccctgggtcctggcctcatccgtaaacatgacgcagtatccatccaggtccctgatccaccccttctcaaaccatccatactgggtgcctccaaaaccatataccgcatcctcattcagatacgctgccggctttccgtcaaacagatagatatgttccccgtcactgtcaatatacgctgccggcgtcccgtttctgtcatacaatgtcatgcttccattctccccatttatttccattctctgctgctgtgtatacccgcagcggatctattatactactgcgctgtcccggattcaatgagtttcttaacataattctaacggtcccttctcttgcctttccgtttgtccttatgttaagctaaaatatatatgttaacataaataacggacaacaggaggtaatttattgaatcagaagctaaaagaaaaaatcacagaatccttatcatctgtgctgcccgttacctgcattgtattaatcctcgggatcaccatcactcccattcccctggacccgctgatgctgtttctggcaggggccgccttccttattataggaatgggattcttcaccctgggagtggatatggctatgatgcccattggagaaaaggtaggtgcgcagctggccaaggcaaaaaagcttccggtcatcgtcattgcatgtgtcatcataggcgccatggtcacagtggccgaaccggacctgcaggtcctggccagacagacaccggcagtgccggacatggtgctcatcctggcagtggctgcaggagtcggtttcttcctggcacttgcatttcttcgctccctcttcggctggagcctttcccacattcttctggtctgctacatcattctcttcatcctggccttctatattccaggtgattttctggctgtagcctttgattccggcggtgtgacaacaggtcctgtaacagttccctttatcatggccctgggcgtgggactttcttccatcggccagggaaaaaacgcggacagcgacagctttggactggtatccctttgttccatcggccccattctctctgttatgatactcggacttttgttccagtcatcttccggcgcctatgagcccatgaccattccatccatcagcaattcccaggacctttggctggccttccagagcgaacttccccactacgcggcggaagtattcacggccctgtttcccatcctggcttttttcctgctcttccagatattcttcctgaagatgcgcaaacgccaggtggtgaaaatcctggtgggaatgctgtattcctacatcgggctgacgctgtttcttacaggcgtaaatgtgggctttatgcccgccggaagctatctgggaaaacagatggcctccctgccctatcgctggattctggtgcccgtggccatgctcatcggttattacatcgtcaaggcagagcctgccgtacaggtgctgaacaagcaggtggctgacgtgaccggcggaagcatatctgaaaagaccatgatgaccggactttccatcggtatggccctgtcgctgggattctccttattccgggtcatcacaggactgccgctcttggccttcctgctgccgggttacgcccttgccctgggtctctcctttgtggtgcccccggtctttacctccattgcctttgactcaggaggcgttgcctccggtcccatgacagccacctttctccttccgctgtgcatgggggcctgcgaagccctgggaggcaatattctgactgacgcctttggcatcgtggccatggtagccatgacccctctcattatcatccagctcatcggactgttctttgagcttaaaacccgcagggagaaagctgtttccagacatcctgtggtggatatggaacaggaattcatcaatttagaggaggaaccttatgagccataaaagtataaagctggcagccgccatcgtgaaccgcggggccgggaacagagctgctgccatattccatacatacaaccatgaaatactgctggctgtcagaggacacggtacagccagctcggcagtcatggactgtctgggactggatgagcctgaaaaggacctggttctgggactttcatccaaaaccgacgccgaccgactgctccgtgcccttggcagggaaatggaatttagcaagcccggacacggcattgctttcaccctttccctcacaggcattagtttcgctgccatggacattttaaaccggcatgaagaccaaaccgggccaaacagccgccccgcagaacacaaggaggatattcccatgacaaattcccattcctatgaattaattgcttccgtcatccacactgacctgtccgcgcctgttatggaagccgccagaaaggccggctgtcagggcggcaccctgataaaggccagggaaataggcagcgatggcggcaaaaagctgttcggcatgaccctttcccaggaaaaagccatactgctgattctgacccccaccagcttaagggctcccatcctgaagtccatatgcgagacagtaatgaaggagaccggagaacacgcagtggcaatttccctgcccgtggatgcagtggagggactgaccggctgatactggcagaaaaaaccgctttctttttaggatgaatcctttataataaatactatcaaaggaaagcaggtgcatcgcaatgtacattggtgatttacatatccattcccgctactccagggccaccagcaaggagcttacgccggagcacctggacttatgggcggaaaaaaaaggaattaacattgtaggtacgggtgatttcactcatccggcctggagggcggagctggctgaaaagctggagcccgccgagccgggtctttacatgcttaaaaaggaatattccttacagcgcccgtccatactgggccagagcagcccccgttttgttatcagcggggaaatcagctccatttacaagaaaaacggccgtgtgcgcaaggtacacagccttatccttctgcccagcctggaagcagccgaagtgctttccaggcggctggaagccatcggcaacatacattcggacggacgccccatcctgggattggactgtcacgatcttttggccataacactggaggcatgcccggatgccatctatgttccggcccacatctggaccccgcatttttcgctgttcggggcattttccggttttgataccattgaagaatgctatgaggagctgactccccagattcatgccctggagacaggactgtcctctgatccggccatgaacgggaggctgtcggctcttgactcctttcagcttatctccaactctgacgcccactctcccgccaagctgggcagggaggccagcctgtttgacattcccatgtcctatgcggggctctacggcgccatacagaggggcgagggccttaaaggcaccattgaattctttcctgaggagggcaaatatcattttgacggccaccggaaatgccatctctgcctcagtccctcccaggccaggaaatataacggcatatgtcctgtctgcggcagaaaactgaccacaggcgtacttcaccggattgaacagctggctgaccgggacgaggatttcctgctgccccagggacgtccctttgaaaacctggtgcccctgggcgaggtcattgcctcctcagtgggttcctccccgtccagcgtaaaggtttccaggcagtacgaacacctgctggaggaactgggcaatgaattttatattcttcgccaggccccgctggaggatatcagccatgcggccggatccctgacagcagagggcatacgccatctgagagacggcaaggtccagtggagacccggctatgacggcgagtacgggaccatgcggctgttccagtcagccgagcttgacaatgtggagggacagatgtgcatgacctttgagacagcgaacgcggatctgagcgaaaccatgggacctggaatcccgggagccccgagtgtgacaggggatggggagctggcagcagatgcggttccttcggcaaatactgcattgtccggcaaagccggcgtttcccacggctcaacggcttcccgtgaagcttcctatgaaacagccgcatcaaatatcctgactgtttccatgccctcctctgccctgaaccgggaccagcagcaggccgtggaatccgtattcccggtaacagccgtcatagccggtccgggtactggcaaaacaaagactctggtgtcgcgcatcgaacaccttatgggcgagcggggcgtaaaaccttctgagattacggccgtcacctttacaaacaaggcagcggacgagctgacacagagaatccgccaggcactgccaggcaggcgcagcctgaaccagatgcaggtcggaaccttccattccctctgctaccggctgttagcccggtccggaacagagctgtccctggcagaccggggacaggcggaagaatgcgcagtagaaaccatagaagccctggaactcccctgcaccgtcaggcagtttctcaccgccatctctctgcataaggcagggctgtcctccgcgcagggctttgccgcctatatggccgatgattccgctgctgaaaccggttttaccctgacgcaggaaggggcagaccggtaccagcaggcactggagtgcaggaagcttatggacttcgacgacctgcttcttaacatgctgcgccttcttgaacagaaagcagaatacaggaagcagcatttttcttatctgctggtggatgaattccaggatatcagcccggtccagtaccggctcatcaaggcatggaataaaggcggacgggaactctttgtcatcggtgacccggaccagtccatctatggcttccggggttctgacagccgctgcttcgacctgctggaacaggattttccgggaaccagcaccatacggcttaccaccggttaccgctccaccccggaaatactctccgcctcccttcctctcatctcccgcaatccgggcggtgagcgcagactctcagccgcccgtcctcacggcggtccggtgcgtctggtgacagcacagaccagcctgtcggagtccatcttcattgccaaagaaatcaaccgcatggtgggcggaatcgacatgctggatgcccacagccagacccccggcctgccggatactgccaggagctttgccgatatcgccgtcctctaccgcaccaatcaccaggcccgtctgctggaacaatgtctgcaaaaggagggaatcccttacgtggtagcgggaagggaggattatctggaccacccggctgtccagggcaccatctcctttttcggggccctgcttaaatcttccgggttagatgaagataccacgaaactctgcagaaaacgcatttccccttccgcagattacagcagcctggcagagcgcttcctaccaagactaaaaagagacaggccctggaaacttctggcggactggatttcatgcctggggctggggtcagacaagtccatggacacctttgtgtgcatgtcctatttccacaaaaccatggaggatatgctgagcacactggcctttggacaggcccacgatctgaaacgaagcggccaggattcccgcccctccgatgcagtgacacttatgaccctgcatgcctccaagggcctggaattccccgtggtctttctctatggcttaagacagggaatcctcccccttaaaacaggaaagaaagctgtgaatccggaggaggaacgccgccttatgtatgtgggtatgacaagggccagggacgaattaattctcaccacctcagaggaaccttccccgttcttagaggagcttcccaaagatgcctgccgccgggaaaaggcccggactcccggcagcgggatgaagcagctgagtctctttgattttatgtaagattttaaaaaccgggcatttcccgcggtaatttccctctcaatacaaaaagacctgacgcacgccatatgatggggcatcaggtcttttcacatattcacatatatcaggaaaccggaatggcaataccgggcatcctatctctcggacataggcacataatccatgttgtcgcctacgtacttggtggccggacgcataatacggccgtcatacagcttattctcaatattatgggccacccagcccacaacgcggctgcacacaaacagaggtgtgtacaaatcccttggaatccgcagcataccgtatgcaaacccgctgtagaaatccacattggtgggaagggccttgcccttgatttcctccattacttccttggcaatacgctcaaagcgcatatagaagtccagctccctggtatgcttctgctccttggccacctccatgcagcaggcccttaagacctctgcacggggatcggacaccgtgtagacagcatggccgaagccgtatacaaggccggaacggtcatagagttcccctgccatcagcttctccactgcctggcggatcttcttatcgtctgcatcaaagccgcctgtttcagccagcactgcatccatcatctctgccaccttgatattggcgccgccgtggcgcggtcccttaagggaaccgataccgccgcataccgtagaatagatatctgtgcctgtggatgcaatcaccacattggtaaaggtggagttgttgccgccgccgtgatccgcatgaagcatcagtatggtatccagcagattcgcttccttggaggtgaatttctggtcctttctcagaaggcttaagaaattctcggcaatggaatattccggatttgcataatggatgaacaggctttccctgtcataataatgcaccttgctctgataggcatagcaggcaatggaaggaagctttgccaacaggttaacacccttgaccagggtctggtatacatcaatattgtccgggtcgtcatcgtaattatacagggtaaggaccgcgtcctgaagcttattcatcagattcttacctggaaggcgcagcaggttcatttccacgaactcatccggaatggtgtagcagtgtctcaccacattgcagaacttttccagttcagctttcttcggcagatatccgaacagcaggaggaaacaggtttcctcatacccgaaatggctctccttcttcccctttaccaggtccagtacatccacgccccggtagagaagccgtccgggaatggccttgattcctccgtctgtctcctcatatcccactacgtcggccaccctggtaaggcctatccgcacgccggttccgtcctcattcctgaggcccttctttacattgtactctttataccatttattaggaatatccgtgtaattctgcgacttcccataaaactgtgcaagaaaactctccttaaccatgtacccatgctcctttctcaaatatccccatcagtgtctgcccctgttatagttgatcagacagccggcctttacgatttcccgctcctctgccgtcatatccgcaatatacaaatccagggttcttatgctgctgccctcttttcccagcacataagccttaatatcctttaaatccccgtccagggctttccttacgtccggaacataaatataatctcccacctcgaagcagggctcctcctccatctggaaaggtaccatgccccagttcatcacattggagcggtaacgcttggtggcatactccttacagatattggccaggcctccgatgactctctggcagctggctgcctgttccctggcagatccgtcgccaggttttacagcataaatcatgcttcccacttccgtgtcctgaaccgtcacattctcattgccttcaatgccgcggatggcgtcaaagagcttctccaaaacaggctccagctccacttccttggccgcgccctcctttgttctggctttttccagcttatccacttccttggcccttcccacatactccgggtcccttctggacaaagtgaattctgccagtcccaggggattggaccggtaagatgaagtctcgccggaaggaatcagctcatcggtggtggtcacagggtccatgattttggaacataccttcaggagaatattgtccgccagaggactcatctccggccagtccttgatattcggtccgtagaccagttccttttccccgtcgcctttgttgtaacccatgtatacccggttcttataggaaatgtcgtcaaattcatactcaggcacattgtcccagccctcaagctcccatgcggaggtaagccttcctccattggctgccgtggctgcaatggaacgcgcgtccatcagggcaaccgcggccatctggccgttacctggtttggatccttccctgttggggaaatttctggtggtatggcggatactcagaccgttgttgcagggcgtatcgcctgcgccgaagcaggggccgcagaacgcagtccgtataatggcgcctgcgtccatcaggtcggacacagcccccttcttcaccaggtccgcaaagacaggctgagaagacgggtatactgccagggagaactcgtcgcagccgcagttctttccctttaatacacgggcagcttccattacgtttgaataggtgcctcctgcgcagccagcgataactgcctgctgaaccatgagctggcccccctcaatcttatccctcagggtaaaggatgcctttccgcccgataccttggcagcctctgcttccaccatgcccagtatatcgtccaggttggccttaaactcgtcaatctcgtatgtattgctgggatggaagggaagggcaatcatgggctttaccgtggacagatccacgtatacgcagccgtcatagtatgccacatccgcgggagccagttccttataatcttcctccctgtggtgcttggccagataggccctggtgtcactgtccgtcttccatatagatgacaggcaggtggtctctgtggtcatgacgtccacgccattgcggtaatcggttgtcatggaagccacgcccggccccacaaactccatcaccttattctttacatatccgttcttaaacacggctccgatgatagccagggcaatatcctggggaccggttcccggctggggcgcaccgtccagataaacggctacaacacccggatatgccacatcatatgtatccttaagaagctgcttcaccagctccccgccgccttcacctatggccatggttcccagggccccgtaacgggtatggctgtcggaaccaagtatcattctgccgcatcctgccatcatctccctcatgtactgatgaatgaccgcaatatgcggaggaacatagatgcccccgtatttcttagccgcagacaggccgaacatgtggtcatcctcattgatggtccctcccaccgcgcaaagagtattgtggcaatttgtcaatacataaggaatcgggaacgtttccatgcccgaagccttggctgtctgtacaatacccacgaaggtgatgtcatgggatgccatgctgtcaaaccgcagcttcagatgttccatgtcaccggatgtgttgtgggcctccaaaatggagtaggcaatggttcctttcctggcggatgcctggtctgcgtcctttcctgtcagtgcctttacctttccgctctctgattccggtacgatttcagtgccgttaaccagataaataccgctgtcatacaatgataccatttcattacctcctggtgtctgattttatgaaaaagggctcggcttggatttttgcctgcccccttacattcgttggttattactataaaacaaaaaaattgatttgtccagtatttttattgtagtcgccacagcttttacattgtggtccgtattggctccgacatgtcttttactgtcacatgctaatactttatcacatcaaagcatctgtgtaaatcaccaatttaatataaacaggccgcagcatatgacaaaatagcctatcatgcccacattcagaaacactgtctgaaaggctctcccctttctcaggggccattgtcccggcaggaaggtaatctggcgccggtacataatgataagagtaatggctgcaatgagacaggccagcatgaaaaacagatatgccagtatcatgatggaggaaaacgctgtcaccagccaccccatgtcaactcccaaaatagattcaatctgccggatcatccacggcccctctgccagtccctgggccccctttgacagttccacggtaacgacaccgcccaacaggttgaacagcatatgaaacccaatggtgtatctcaccttccctgtctttgcatacacgtaggcccagagaattcctatgccaaaggcataaaagaactgggaaaaattgccgtgggccatgccgaacataatacctgacatgatgatggccgctttctgtccatatcccagcagccggtccataaccatcttcctgaaaaaaagctcctccaccacaggggccataatgaccgttgtcagcagattgacccacaggctggaattcctgataagctggtccaattcagcggagtccggtcccgatggctgtaaaagccctaccagcctgcccagaatatttcctgccagcccgattcccactgcaatgacaaagaaggacgcaaatttccagaatccccactgctccttctggggcgaaccgcatttgggcacaagtttaaacagaccggccaccacgggaaaggccaccagatacatgggcagggacgacataagcatacgccccgaaaatccgtagaaatcaatgaaatctcccagcagggaatcaagcagcatcaccaggaccataaccaccacctgggccgccagggtaatcagcataaatgcggccgccgccattcccacatgtgagaactgcttcctctggcgcctttccatggcagctgcctgctgcgggtcaggctgcgggctgtactgcggggcctgcatctgcggggcctgcatctgtggagcctgcatctgcgggtcaggctcccagacccttcccctgttttcatcatcgtatatcataggccaaatccagtctccttcatcagaacttgtatactgccaaaagacagttctttttagtgttgcaattgcaacaaaaaagtattatgataataaatatcataccataaaagatagcagggtaaaagaaacatgacagaatattttcagaaaaacctatttaaagacatctccatcgacgagtataaaaaactgctctcctgcctggacggaaggacaaaacagttcagaacaggcgaaaccatatgtgattacgacgaaggctttcatgaaatcggcattataggcaagggcactgcctctgttgtccgctatgaatacaacggtgccagaaccatcctggagcgcctgggcccccaggacatcttcggccacctgctgtcctacgagggcagcgagcacgccggtatcagcgttgtctgcgacagcccctgtgacattcttttcatccactatgccaccatcggctctccctgcaccaagtcctgcgcccaccaccaccagctgacccagaatctgctggacctgatttcggagcgtgccttaaacttaagccgcagggtggaggtcctgtcccagcgcaccatccgcgaaaagcttatatgctatttcatgcagctggccgcccaggccaaagcctcctccttcagcctcccctttaccatggtggacctggccgattacctttccattgaccgcagcgccatgacaagggagctgaaacgcatgaaggaggaagggctgatcgaaatggacaagcggtgtgtacgcctattcctttagcctgtcttcaaactgccgggcgctcatggggcgcccgaaataatatccctgtatatattccattcccagttctcttacagcctcatattcctcttctgtctccaccccctccagacataccttcctgcccacatcatggcacaggtcggtgatggatcggataaaggtggcattaaaaagatcggaggtaattcccttcacaaatcccctgtctatcttcaccacatccacggggatgctttttaatgaaaacagggacgaatatcccactccaaaatcgtccatggcaatttttaccccaagctccttcatctgagcaatcatgcggagggtgtcctcctctgcctttgccagatatgtctcggtcagctccaggataatttttgaaggcgccaggctgtgctcctctaacgctgtccggagaaaggaaataaaatccccctgggcaagctggatgtaagacagattcacacttatctggaaatccggcctgaaacggcaccactccaggcactgggccatgccgcggctcagtatccactgtccaaaaggaatgattaaaccgctctgctccatcaaagggataaactcaccgggagaaacatctccgtacttggtgcagtgccatctggccagggcctcagctccgcagagcctgcccgacacagtgtctacctggggctggtaatggatggtgaaccctgcaaagccgcgctccacgctctccctcagaagctccagcagctccagccgccgctccctgtctgccaggatatccctggaaaacacggtcatccggttctttcccatgattttggaatattccagggaatagttggcgctcttaaggagttccagataattactcccgtcccccggataagcggcataccccgccgacagggtgcagaaatatttctttccgccgtactcctgctgcttgcagaagtttttctgaagcttgccatatatatgggccgcctctttcgcgtctcctcccaggaggagaataccgaactcatcgccgtccagccggtagagcatggcgttgggcggaagcatggacgccaccttctgggccgtaatacgcagaacctcgtccccgaaggaccggtcatacagatcattgatgtttttaaaggaatccatgtccagcaccataaggccgatggagtccatgcatttgcggtctgccaggtacttcttgatatttccctcaaactcgtatttgttgtaaaggccggtcatatggtcaatctggtttttctttccaagattgctaatcatgccggcaaataactccggctgcccgtccttatccctgagcatcttcccccggcaccgcagccatatccattcccctctcacattcctggcccggtactctatgttatgataatcctctcttccgtctgctatactctgattgctctccagaaaataggcttcatcatggggatgaatcagctgaccccaaaatgcggctgcctccctgaccacctgccccggcaggccgaattcctccgccatggactggggataacggaataccccggttttcatgtttccaacaaaaatataatcgtccgtgctggctgacagcgcttcatagagacattcgccgtcataatcaaaggtctcatccctgccctcagatttctccctgagcctgcgcctggcccgctctatgtgatatcctctcttctgtacatacatctgttcatctgccctggatatgatgtcctccactgatcccatatcccccggataaacctctgcgattccataactgaaggagacatcatactcttttcgcaggtgttttcgttcctgccctgccctggataagagccgcttcatgctgtcgtccgccgctttcatgtcacgcccgtagaataccatgacaaactcatcaccgctgagacggtacataaagtccagccttccaaggcactccttggctatggctgccacatactgaagaagcctgtccccctcgctgtgtccataccggtcattgaccgctttcagctcgttgatatcatacagcaccacggtcaccacctggttctcgcggcctccctgttccagggcctgcctgaggcgttcaccgccgccgcggcggtttaacatgcgtgtcagttcatcggtgcgggctgtctctgaaatctggtcaaattccgtcatgtccacagaattctgaatgtggtataccttacccttccactgaatcagactgtcataattcctgtatttcctgccggtcacggaattggtctcacgccagatgcagattcgattgtcctccatctgttccagctgcctgattttgcagtaaggacaccgttccttcatgtccttttgcagaacctgccagcagatgcagccttccggccttgcaagcccgaaggtctccttcatggttttattcatataaaggatttcatccgtttctacatccgttatatagaaattggtgtccatctggtccaaaacagctgccaggaatgtatccttaaataagtgttgctgttcttccatctcaaaaaatcctctttaccgtatttaaaagttctcctcttattgtaaactctttccagatgttgcacaagggggaaaatcaaataaaaggcgcccctcccggatgaaacatgggaaggagcgccagagcacttcttattcttcaacaacagagaacatatcttttccaactccgcagataggacatacccaatcatccggaatatcctcaaatgcagttcccggctcgattccgccatccggatcgcctgcctcagggtcatatatccatccacatggatcacatacatattttttcattatcatatcctccttaattaccatatcatttattttggttttaaatcatttcctttgatgtcattactatatcataagtgttcctatttttctgtgacatttgcaacactgaaaatcatttttaatataatgtttcatttgccgcatattccgccatgcctgcgtggaaacagctgcccaaacttactccgggcagctgcgtcatttgcttttattcgccgtccttagctgcggccctggcctctatctcacgtttctgtacatcgccgggagcctgctcatagcggctgaattcataggaataatcccccagaccgcctgtcatggaacggaggtccgtattatatccgaagagctcagacattggaatatccgcctcaatgacctgcttgccgttgtgattggaattcataccaagcacgcgtcctcttctgcggtttaaatcgcccatgacatcgcctgtaaacttatccggaacagtaaccttaagggaggcaatgggttcgaggagcacgggatttgcttccataaagccctgcttaaaagcaaggatggtagccatcttaaatgccatctccgaggaatccaccggatgataggagccatccagaagagtggcctttaagcccacaaccggatatcctgccactggtccctttaatacgcattcctgcagtcccttctcaacagccgggaagtagttcctgggcacggaaccgccgaataccttttcctcaaatacatacggtgtctccaaatcgccggatggctcaaattccatgatgacatcgccatactgtccgtgtccgccggactgtttcttatgcttgccctgtacttttactttcttgcgcagggtctcgcggaatgcaaatttaggctggcttaaggtcacatccaccttatagcggctctgcagcttgctgattaccacatccagctgctgatcgcctatgccgtataacagggcctggcggttctcagcgtcgttgaccaccttaagggttaagtcttcttccatcatcttagccagagccgtggataccttgtcatcctcgcccttgttcacagccttatatgccatgtatgtgtatggcgtggaggtctggggcttatggtatacaatgggtgccgtgcgcacagccatggtatcgccggtctgggtcacagtcagctttgcaacagctccgatatcacctgctttcagctcctgcacctcaatctgatccttgccacgcaggatatagagcttgccgatcttttcctcagtatccttattcacattgtacaccaccgtgtcgcccttaagggtaccggtacaaattttcatcagtgagtacttgccgatgaatgggtccacaatggtcttgaataccctggcggacagggatacatcgtcgttgtacttggctgtaaagcgctcgcctgtggaaacatccacgccgatacactcaaaatggtcaggtgacgggaagtatttgtcaatggcctgcagcaggaccttaaagccctggcagttaattccggaacccatcatgacaggaacgatgtcaccttcaataacgtgggtcctcagcgcggtggaaatctcctcctgggtaaactcttccccaaggaaataacgctccatatattcttcactggtctcggcaacggcttcaatgagggcgtccctggcaatggtcaggtttttctggacataatccggaatctcacactcttcataatcacttaaatgagtgaaacggcgtccgcccatctttaccacattgacgaaacctacgaacttttcattttcacggattggcagctggaacggagcaatcttacgtccgaacttagtctccagcttaaccacaagctcacgatagctggcatggtcatcgtccatatttgtgacgaaaatcagcctgggcaggttgtacttctcgcacatctcccatgccctctctgtaccaggctcaatacctgccttacagttgacaacgataatggctgcatcggcaacactgattgcctcctcaacctctcctacaaaatcaaaaaatcccggcgtatccagaaggttaatcttaattggcccgtcctcgccctcatattccagaggaatcagggtagtggagatagaaaactgtctcttgatttcttccttgtcataatcgctgatggtgtttccgtccggcaccttgcccatacgttttgtaacaccagtcagcagcgccaatgcttccgcaacggttgtcttaccagcgcctccatgtccaagtaatacaacgttgcggatttgttcagttccatatacgttcataaacttccctcctgttcattaaatttaagcctatgcgtatattttactaaatttttcagaatttttcaagcattttatatgatttgcacaacattcttttggggttgcctgtccggccgcagaaaacaacgtagattcacgcattggcactgctggattccccatgtgtaagtttattattcttaattctttttggccggataaaaggccggttccctgttccactatataaaaagcgcctgatagccaattgaactatcaggcgttacatatgcgcatattctgttgaaaatatatcaacgattttggccttctgttttcctatcagcttttccaattctattgctgataacagtccccttagatacacttgaaccaattccagctgattcgggccgatggctgccaccagttccaattttgtaatatcattcacctcctcacattccttccatttaactgtatgataacacaatccaccctgtcctgctctaaatcgccgtaaaaacattgtatgttccatgtaaacttaacctcccaaaagactgcctttatagtatgtctgcccgcagaaagcagccttcattcagactgctttctgcaacgatacagataaaactgccgtttcatgacatcacaatatcgtttcaccctgctaccagttgcgtacaccctgtatgtgtatgaaacggaccttttcatagatataggaatccaggggccgcatatatgcatcataactgtgggcagccaccaaaatattatttcccgccacatcaacaatcacaggactgtggtaatatccgttcttatttcccagctgtacaatatcgcccggctccacgcccttttcgttggtttccaccccatagggacctgcggatttatttcctgtgagaaaattataaagatacacgaccccggtccagctgggacttctgttggagccgctgctgtaataccatcccatggtcggcgtgtagttcatgaccccgcttccggcataaatacactgggatgcaaaattggtgcagtccccgcccaaatgttcaaaatccagataccgcggattcctccccttagcccatcgtttcgcatattccaggacagcttccctctgatatccaatctccttcaatattctatgattcctgttctgtctcaacatttgttatctattatatgaccatggatatctaatttatatcatgcctaatttatatcatgctttattgtttgaatgaaccccttccgaacaccatgctgcaaggttttgtaaatccgggtgcgcagtagtatattcagaatatggaaatgactgtggggatgtggtaaaatgaatgaatccgacagaattttcgtggcccgaagcggcagacgtatttacataacaggagggttcaaatgaaattttatattgcttccgggcttcaaaaccatgagcaggtccgcagtcttgccaaactgcttaaaaactccggctggacacatacctatgactggacgtctcttctttatgaccggacatcccatgtctcagagaaaacaacagatatcgaaacactgaggcatattggcgaacaagaatataatggggtaaagcaggctgatgttgtcattatattgactcctcagggaagaggaactcatacagaatttggaatggccatcgccctgggcaaaataatctatttgtgtcatgaagatgatacgtatttcaaatgtgatgataatacatccgcgttttattggcttccggaagtaaagcatcttattggaaatacagattatattgccgcccagctgcttaaggcctgttttcatccgcacttaaaagcgtaaaagtttaaagtgataaagtattgactttttctgcagagtcgcttacactattactgcatatgaatcattctgaaaaatacatactatggtccatacaatctgcatatttataaatttgcataaggagtactgaattatgattatcattatgaaacccaatgcttctgatgaagcggtcaaaaaggtaacaaacctcattgaatccaagggactcacagcccatctgtccaagggttcccaggttaccatcgtaggcgtggtcggcgacaagaccaagcttttggacaccaacattgaaatcagcgaaggcgttgacaaggtagtggctgtcacggaatcctataaactggtcaataaaaaattccatcctgaggactcggtgattccggttggcaacacccacatcggtccgggcaccatgaccgtgatggccggtccctgcgccattgaatcccaggaccagcttatggagactgcatatgcggtgaaaaaggcaggagccaccttcctgcgcggcggcgcctataaaccacgtacatccccctactccttccagggacttgaggaggagggccttaaatacatgaaggaagccagggaagccacgggccttaatgtaatctgcgaagtcaccagcgcccatgccattgagtcggctgtgaaatatgtagatatgcttcaaattggcgccagaaacatgcagaactttgaactgttaaaggaggctggcaaatccggcacccccgtattgttaaaacgcggattgtgtgctaccattgacgaatggctcaatgccgccgagtacatcatctccgagggcaaccctaatattgtgctgtgtgagcgcggcatccgcacttacgaaacttccaccagaaacaccctggatatcagcgctgttccggtcatacgccagaagagccaccttcccattatcgtggatcccagccatgccacaggtgtcagagcctatgtggagcctttggcaaaggcagccatggcagtgggcgcggacggccttatgattgaagtccacccctgtcctgcaagggcactgtctgacggtccccagtccctgacctttgatgcctttgaacagctgatgaaggatttagctccttatgcagagctgtccggacggacctttaaggcacagtaacagaactttacggcactctcacttcaggagtgcttttacatatgcccggtgcgcggcctctgcccttacggcatccctttcatacatttaatccggcgcatccggtccccgcatttacaggaggagataccaatatggaaaaaatgaccatgaccgattccaccatcgcattcatcggactggggcttataggcggctccattgcccgtgccatccgaaaaacacggccggatatccgtatcatggcctatatgcgctcccgctcccgtctggagcaagcccggaaagagggaatcgtggatgtgattttggatggaattgatgagaacctgcgtgaatgtgacctgattttcctctgcacaccggtggaatacaacgcaggttatctttccgccatacggccctatctgaaacagggcgccctgattactgacgtgggcagcacaaaaagcggcatccatgaggaaatcagacgccagggcctggaatactgttttgtgggcggccatcccatggccggctcagaaaagaccggctatgagaactccacagaccatctcctggaaaatgcctactacatcgtcacgcctcctgagggaaaaaacagctcccgcccccaggatttaagctccaatgcagaacgcattgtggcggttgcaaaaaccataggagccattccccttgttctggattacagggaacacgacaaggtggtggctgccatcagccatctcccccatctggtagcttccagccttgtgaatctgattaaggatcacgacacagcagacggcaccatgaagcaggtggccgcaggcggttttaaggatatcacccggattgcctcttcctcccctgagatgtgggaacagatatgcatgaccaatgtggaccccatatcggacatcctggaagcatacatcgcatctttaaataaggtgctggaggaaatcagggagcataagggacaggatatctacaggctgtttgagacctcccgtgattaccgcaattccattacagacaaggccaagggttctgtggagccatcctatgagttcaccgtggatgtaagcgatgaggtgggcgccatttccaccatatccgtcatcctggctgccaagggcatcagcattaagaatatcggcatcaacaacaaccgcgagcggggtgagggggcgcttaaaatcgccttctatgacgaggcttccatggaggctgcgtggcagaggctggataaatacaaatacgagatgttccgcatgtaatccggagagaaaggttaggtaacagattatggaatttaaaagagcatcccatttaaagggcgaaatcagggttcccggagataaatccatctcccatcgggccgtcatgttcggctccattgcacaggggcttacggagatacacaattttctccagggagcggactgcctgtctaccattgcatgttttgagaaaatgggcattgatatagaaaacaagggcgggcaggtgctggtccatggccgcggcctgcacggactgaacgcgccacgggaagtcctggactgcggaaacagcggcaccaccacgcgcctcatatccggaatcctctgcggccaggactttgacgtcactctcacaggagacgaatccatctgcaaacggcccatgaagcgtattatggagccccttgccatgatgggagcccgcatcaccagcataaaagacaatggctgtgctcccctgctcatcaagggaggtccggtccacggcatccactatgactccagggttgcttccgcccaggtgaaatccgccattatgctggctggtttatatgcagacagccccaccagcgtgaccgaaccatatgtgtccaggaatcactctgagctgatgctgcggctttttggagcccaggtgtccaccgaaggaaccacggcagtcataaagcctgccggcgaactccatggcaatcaggtcatggtgccgggagatatatcttctgccgcctatttcattgccggaggcctcatggtgcccggatcggaagttctgatacgcaatgtgggaatcaatcctaccagggacggtatcctgcgtgtatgccgtgatatgggagcgcatatagagcttctgaatgcaggcagcggaacaggcgaaccaacagccgatatccttgtacgccacggcacccttcatggaaccgtcataggcggctccctcatacctacccttattgacgagcttcctgtcatcgcagccatggcctgctttgcagagggcgagactgtaatccgggatgccggagagttaaaggtaaaggaatccaaccggattgcggtcatggtccagggactgactgccatgggcgcagacgtgacagagaccgaagatggaatgattatccggggaggcgctcctctccacggagctgtcatcgacagccgcaaagaccaccgtatcgccatgacatttgccgtcaccggcctgtgtgcggacggcattacagagataaaggacgctgactgtgtcaatatatcctatccaggcttttacagcgatttaaagagactggcacagggataagcaataaccgcatccgctccggctcagcccggatacggatgcggtttagtttttgcggttctgttttgtgcttctgttttgtgctatggtatggtgccgtgcctttcctgtgcctgttccaagtgattccagatatacgtctgcttgtgattccggcggccgaaagggccggatttccttttttagattttcgtcctatcccagcgccacatccagtatcatcatcaccacaaacccaacagcaaatccaatggttgccacattggaatgctctccttcggctgattccggaatcagctcctccactaccacgtatatcatggcgcctgccgcaaaggacaggaagtatggaagaaccggacctaaaaactcggccagcaccagcataaggagggcgcctatgggctccaccacgcctgaaagcgtgccataaatgaacgctttcccttttccggctgcctccttaagaggcagggatatgatagctccctccgggaaattctgtatggcaatacccacagacaaagccagggcgcctgccatggtgatggtcccgttctgggacaaaagtcccgcaaacgcaacgcccactgccattccctccggtatattgtggagggtcactgccagcaccagcatagtactcttcttccagtcgctctttggaccttccggctgctctgtatcaatatgcagatgaggtatgatctcatccaacaggagcaggaaaccaattcccagaagaaagcccacggaagcaggaatgaaagccagctttcccatgtgcccgctcatgtccatggacggaatcaagagggaccagacagacgccgccaccattacccctgacgcaaatcccagaaacgccttctggacactgggcttcaatgcgtttttcagaaagaacacgcaggctgcccctgccgtggtcccgataaagggaatcatgattcccgcaaaaatactgctcatctcaatgcacctctgtcatttcctgagccccggtcctcccttctacaggaatcctttgagcttcagatagtcttttatcagttgaatcatctggtcgtaatcaatccggctggcattgatgggaaggtcataattttccatatccatccactctctgccggtaaaatagcggtgatactccgttctctccttatcaatccgtctcattctgcggagcgcttccgcctcatccaccttatccacatccatgaccctgcggattctggtgaccgtatccgcatacacaaagatgcgcaccagattatccatctggtcctgaagcacataattgccgcagcggcctacgataatacatgtctcagaggcggccagcctgcggatgaccgatgactggaaccggaacaggttctccggcgaagtgatgttggggccgtccttatccggttccgtcagctccggcttcatgccggtcacgatacggtatagcaggttatttccggccctttcatcagccagcctgaaatactgttcccctatggcgctggtctcagaggtcatcttaagtatctcttcatcataaaaatgaatgccaagctcctcggccaggcgtttgcctgtcaggcggccgccgcttccgtactggcgttcaatggtaagtacaaaatgtttgtcattcatattgagtatcccccttattcctaatccgcagccctgcccgtgacacggccgcggtctctttcatgtctatacaatgtctatatggcacatccccatggcgctgagggcattgcggtggctctggggagtcacacctgcgcagcaagccccgtccacctgtatggatgtgtcaggaactgccgccttaatcagcatggcgttggatatgacgcagatatccgtgcacaggccgaccagctccacaaagtcgtaccgtcccacggctgcgtaatcagccagctccctgcttccaaaggtatgcttctcaaaacgggttcccggaacttccctgagctccggtaccagttcccagcccggcgttcccttgacacagtggaccacaggaagcttcttcccttccattgtatccatataatcgtcaaaatgggtgtccagggtaaataccacctcatcccctgtatcccggtatgccttaaccttatccagcacattagggacaatggcccgggcctcagggctgcccaacgctccatccacaaaatccttctgcatatccaccactacaagtaaccggctcatggaactttcctccttgctgtgaacactttttatttgtaaacacctttgttccggtaccaaagtgttcctttccgtacctacagtttaccacatttcatcaatcaataaaagttcttttacacttttgtgcgtcattgcatgactttatatgaattttcaaaacactcttgacaaatctatttaattgtattaagatacgggttaataaattaaaccgtagagaaagaggagtaagctatcaaagctttagcacagagagccgcaggcggtgggattgcggtatagggctggcagctgaatggacttttgagggcggtcttgaaggattgttttatctgtagggaccgacggattccgcaaccgttatacatgcggcgcatatgttggtatgtgtaaagaggacttttagtcaatttgagtggcaccgcggatttcattcgtctcaatcatagcataagctatggttgggacttttttattccggctttattcaaacggcagcccgtcagaaagtcccttatccaacggcattttttatcatacaaatatagttcaaaaacaggaggaaacaaaattatgaaaaaaacaattgcaatggtcttaactgcagctttaagtgcatccctcttatcaggctgcgtatccactacacagaataccaccacggcccagcccgcagaaaccaccgcaaaagccgtggctgaaaacgaagcttcccagagtgcagtcagcaccgctgagggcgggacagctgagtccaggacggaatcttctgccgacagcgcagcctacaccatcggcgtgggacagtttgcggagcacggctccctggacaactgccgcgaaggcttcatggcgggcctggcagaggagggcatcgaggaaggcgtgaacctgaccgttctttatgataattcccaggccgacggcggcacggccagccagattgcaaccaatttcgcaggcaagggcgtggacctgatgtgcggcatcgcaactcccatggcacaggcagagtacggtgtggctaagaagtcagacattcctgtcattttcactgctgtaaccgaccccgtagccgcagagctggccaatgcggacggcactccggtaggcgagattacaggcaccagcgataaacttcctgtggaagcccagcttaagatgatccgccagattcttccggaagccaaaaacatcggcatcatgtacaccaccagcgaggtgaattctgaatccgccattgcagagtacaaggagctggctccccagtatggttttgaaatcgtggacacaggcatctcctcttccgctgatatcgccctggctgccgacacccttataagcaaggtggactgcattaccaacctgaccgacaacacggtagttgcctcccttcccgttatccttgataaggctgccgccaagaatatccctgtattcggcagcgaaattgagcaggtgaagattggatgcctggctgccatgggactggactacatcgaactgggcaagcagacaggaaagatggcggcacaggtactgcgcggcgagaaaaaagccagtgaaatgaattacgaaaccatcaaggaagctgccttctacggcaacacacaggtggccgggaatctgggcatcacactgccggaggatttgactgaaaatgcagctgagctgttcactgagattgcccagtaaagctctatcattattatctggaggaacatcatgacaacgattattttaggtatctttgaagaaggcctggtgtacgccatcatggccctgggcgtatacatcacataccggattctggattttccggatctgtcggtggacggaaccttccctttgggagctgcttttaccgctaccggcattgccggaggtttcatccatccggctgcggcccttcccctctcctttctcctgggagccatggcaggctgcgtcaccggacttatccatgtcaagttaaaggtacgggacctgctgtcgggaatcattgtcatgaccgccctctactccatcaacttaagggttgcaggaaagtccaacctgcctatattcagcaaggacacgattttcagcaatccatggttggaacgcaccattccccaggccttaaggccctatacagtgaccatcatccttctggttatcgtccttatctgcaagctgctcctggacgcttacctgaaaacccgttccggctatcttctcagggccgtgggtgacaatgatgtgctggtaacctccctggccaaggataagggcatggtgaaaatcatcggtctggccattgccaacggatttgcagccctggccggcagcgtgtactgtcagcagaagggattctttgagatttccaccggcacgggaaccattgtcatcggtctggccaatgtcatcataggcacccagctgttcaaacggttcggctttgtcaagtccaccacggctgttatcatcggctccatcatctacaaggcctgtgtatccctggccctgcttctgggggacttgacgcttacctttggaaacattactgtttccttcccggtgacagcctctgacttaaagctgattacatccattttgttccttattatcctggtggcaagctcctccaggggaaagaaggtgaagagccatgcttgaactgaagcacatcaataaatactacaatgccggtacagtcaatgaaatgtgcctgttcgaggacttcagcctgaccataaaggaccatcagtttgtgtccgtggtgggaagcaacggctccggcaaaacctccctcttaaacatcatctgcggcagtattcctctggatgagggacgaatcataatcagcggaaaggacattacccggattcctgaatacaagcgccagcgccgcattgggcgggtttatcagaatccggccatgggcacctgtccgaccatgaccatactggaaaacatgtccctggcagacaataagggaaaggcctttaacctcaggccgggaaccaaccggctgagacaggagtattaccgcgaatccctccgctccctgggactgggactggaggataagatggatgtgaaggtgggagtcctttccggcggccagcgccaggccatggcccttctcatgtccaccatgactcccattgaattcctgattttagatgaacacacagctgccctggaccccaagactgccgagaccatcatggagctgaccggaaagattgtaaaggaaaaaaatctgaccaccatcatggttacccacaatctgcgctatgcagttgaatatggggaccgcctcctgatgatgcaccagggccgcgccgtggtagacaaagaggctgaggaaaagcaggcgctctgcattgacgacattctggaaaaattcaatgaaatcagcattgaatgcggcaattaaattaaaaaacagactaaaagaggacccccaaccgcaggacagcggtttccgggtcctcttctgttttcttttattcctgttccttaaaatactttttccggtaccgtatggaccgcttcagcgcctggaccatatcagccataatccgaatctccacctcgtcgcagtcatccacagcctccataaccgcatttttaaaaatgtgctttccatatcgtatgttatcgcaaagcagcacatccggagtaatctccagggcattggctatggcaatcagggatttaaggctcacctgggtacttcctgtttccacattggaaatatggggattggataatcccgtaagctccgccagtttttcctgggtcatttctctttgtattctctgtatcttgattcgttttcctattgccttatagtccagttccatattgtatatacaacttcctctgcttattatttacttgactattgtaatctttgtattagtatattataataaactggtcattttatactttgtaatacaatactaaaaactccttttatttacagctaataaggagtaagtacagccgttcggtgataggtattaagtaatcaaaaagagcaatgaaatattgtaattcgcttttttctatgccatttatgggcggctttctcacagggggcgattcatatgattgaaaccaaggaaataatgagccgggaagctgtcacaggagggatttttgaatgcagatatgatgaatccctgaccctgacccaggcagacaacagcctgttccggctactgggcatgaacgcaggcagtcttacgtcaggtactcccatctcctttctggaccggatatgcgcggaagaccgcccaatcttcctggaaaaaatacggtaccagctgtcccgcagccgtgtattcatgtctgagctgcatattatgaccagcaacggacagctgcggtggattcatatatgcggcgagctccttacggaacaggaatcccccttactccactgtatcttccacgacgtgacagatgccagggacagacaggaacggcttgccatagaaagccagatctacgacatcatactgtcccaaacccaggatatcatatttgaattggactgtcttacccgggatatctactattcccccacctttgagaagaaattcggataccagattccggtcaggggattcccggactctatgtttgccactgacatcatccatgaaaaggataagatacccctgcgaagctgttttcagtccatcctggcaggccaggaccagatgcagtgcgaataccgtttaaagcacaggaacggccgttatctctgggtcagcgtgaatgccacggccatccgggatttaaggggccggctccttaaaatcgttggcatcatctctgatatcaatgagcagaaggaggagatactccgggcaaaaaaggacgccctgctggatcctcttaccagccttctaaaccgcagggaatgcatccggcggatcgaagcctacacaaggaccgaggaagagatgggggcgctgattctgattgacatagataatttcaagtccatcaatgatacaaacggccatcttttcggtgacaaggttctggtggacctggccgcggccctccgtttggccttccgcagaaatgatatcacagcgcggattggaggagatgaattcattgcattcatgcctcacatacatgtccatggggatgtggtgccaaagcttgaaaccattctctattccctgtcccggtgcgcaaagacgggcgggaaggaagaaacggcaccggagccggacgacgcggttaccttcagcatcggggtcagcttttatcctgaccatggaaaggatttttcctccctctttgaaaaggcagacgcagccatgtaccacgcaaaacgaagaggtaaaaaccaatattacatatataaggaagatgcaccccaggcatacgactcctgacgcgtacgggaaggaagataatgccggcgcacctataaaagggctgatacccggctttgttcctatgccgggcatcagcccttctccattcctgctgcattccctggcaggatactgattattctgcaaataacataatcttggaagctgtattttcatcatctgaccagaccacacatttctttccctgtgtcaggtcatccagagtcacgatgtttctggtgagatacgggaagatgttgcagtcctctgccagtgtgaactcggttccgtccgcagctgtcagcacggattttgatgtgccggcatctgtaaccatggacttgacctccacataatcaggcgccttggcgtctgccggaaggttggtgaaaatcatgaccgcattggtcataggcggaaggctcatggtcatggccggccctatgtaggcgtaaatggtatccccgtcttttacatcctccagagctaccgggaagcctgtcatggcatccaggatataggtcatatcgtcagccacattcaggatgatctcaccgctggtactcatgcccgactgattgtcaatggaaagcctgccgtcctccatctttgtcacaggtccgtaaatccggacggactggggaacctcgggctggctctcttccatgctctcaatggctccggtcaccgactcaactacggtggtgtcactcacggtggtttcttctgtattctcttctgctgccacggagctgccggacacggtctcggcgttgacacctgctgagcatcctgctgctcccagggcaatggctgcacagattcctactgcatataaatgatattttctcaatataatcttctccttttcatctgcctcgcaaaaagccgtgggcctgccggaggcacttgttatgtctgtatgagaagtatatatcatttactgtccatatccaataaagtatttcttaagaattctgaatttagaatgaaccttatgacaaatgttacaaaatgtttacacaaatacagtctgccattaccgggccatctcgctctgaggtcctgcctgattgtgggcatggatgatggtctcgatttcttccaggttggaagacggcaggtccccgggaatggtgttcttgacagcagccgtggcattgccgaaggcaacggccctggcacagtcgccgtctgtactgagcagcccgtaaagcgccccggatatataggcgtcgccgctgccgatccggtccaccacctcaatatcccggtacggctcctcctcatagtactcatccctggctgcatcgtaaatcacagagccaaaggtatgccgcttggggctgtggacgattctctgggtagaggccacaatggagatagggaattcctcggtaaagctcttcatcatctccctggcagtgccggtctttaaaaaggtgagcctggcagtgtcctcggaacagaagaagatgtccacataaggaaggattctcaggatacactccctggcctggtcccctgtccacagatttcccctgaagttaacatcaaaggataccagggtacctgctgccttgaaccgcttaatcatctctatggtggtctcgcggatgtcctcgttcagggccagggtgatgcctgtggtgtggaaacatttggaagccgtgtacacctcctccggtatctcgtcaatatccagggagaaaaaagagctgtggttgcggtcgtaaatcactttcggctttctgggataagcgccgttctcataatagtaaatgccgaccctggctgcgggggactggtcatacataaagaaatcatcgctgaccccgaaggaacgaatcttgcctttcatgaagcttcctatatcatgggccggaagcttggatataacgcctgtgtgaagacccaagagagccgcgcccactgccacattcagctctgcgcctcccacctgcttgacaaaggtatcgcctctggacagacgctcgttatccgggggcgacagccgaagaagcacctgtcccaatgtaagaaggtcaaaattcctgccgtttgtttctaccatatcatatctccttttcaaataaaaacctataagaaaccatataagaaacggctaatacctctgaaaggattagccgtctctgattgtctgattgtcaatatcctgatttatctctgaacacggcctgaaccgtcgccgccggccagattctcaacatcagccctggttaccaggttgaagtcgccgggaatagtatgctttaatgcggatgcagctactgcatactccagggccgccttcatatccttgccatccaccagaccgcagatcaggcctgctgcaaaggaatcgccgccgcctacacggtcaacgataggtgtgatgtggtactttctggagtggtagaactcacgtgtctttccatccataatgcaggcagaccagccgttatcggaagcgctgtggctctcacgcagagagctgatgatatacttgaagccgaacttatcagccatctggttgaagatgtcaacgtatcctgccagttccagctcgccggaggtaacatcggtgttgcccggcttaaagcccagaaccttctctgcatcttcttcattgccgatgcagacatcaacgtactgcatcaggttggtcataaccttctgagccttctcagaggaccacagtttcttacggaagtttaagtcaacagacactgtaacgttgtgtgccttggctgcctttaatgctgcctcggtaagctcgatggctgcatcgctgacagctggtgtgattccggtaaagtggaaccagtcagcatctgcaaaaatctcgtcaaaattgaactgatccgcagttgcagtggagatggagctgtgggcacggtcatagaccacgttggaagctctcatggcagagcctgtctccaggaagtagatacccagtctctcgccgcttctggcaatgtgctttgtacctacattatactttctcagtgcagccactgcgcactcgccaatgggattagccggaactgcagtaatgaattcagcttcatggccgtagtttgcaagggaaactgccacatttgcctcgccgccgccgtaattgatgtcaaactcgtctgcctggatgaacttctcattgtttggggtagataatcttaacatgatttcgcccatggtaacaatctttgccattgtatgattctcctttaatctcttcttaataatctctttttaattatatttggaatgatgcttactgtaaggtatcatctatgcccttgccgctgcaacagctgccacgaactcctgagccttagctgtaacggccgcgaagtcgcctgtcttggcgccctttgtcaggctgcttcctgttcccactgcgtaagcgccggccttgatccacttgtcaacattatccacgtctacgccgccggacggcatgaactcgccctgtggaaggggacccttgaaggaactgatggctgcaggtcccacgatgttgcccgggaaaatcttgatgatatcacagccggcttccatagcggtaatggcctcggatggagtcataacgcctggcagcatgggcactctgtaacggttgcacagacggatggtgtccacgttcaggcccgggcttacgatgtagttagctccggccaggatgcaggcccttgcggtctcaggatccagtacggtaccggcgccaattacaatcttgtcattgcctttatacttctcagccatcagtttgatgaagccaaccggatctccgtcatccatggtcatggtaagctcgatgaagttgatgccgcctgcgatgatggcgtcaactaccttctcaccctgctcatagttctttgcgcgaacaacagcaaccagacagtcttctttcattcttgctaaaacttgttctttcttcatcttcattctccttctctttaaattcgcatatgcgaatcactttcataattacgatttgtatacttaaattctaatcgctgtcacatgatttgtcaacagcaaaacaggtaaaaatataagtttattttcctatacatgcccgatgtatcccaacagccgtgacagctgggctcccttatcgcttaccaggcgtcccagggcgtcataatcctcggtgggtttatacaggctggagacgctgatggctcccatcacattaccatcctgcccaaatacgggagctcctacgcattccatgtgttcttccagctccctggcgtcaaaggcatatcccttttcacgcaccgatttaagctccctctcaaattcttccctggtgcagatggttctatccgtgtgcttcttaaagctgatacgggacagtacgccgtcccggtcctcatcctccgtgtaggccatgattgccttgccgagggatgtgcagtaaatgggattttttgttcccacagtggccgtggtgatgatgggattctctggttcaaacttgcagatatacacaatggaatcatccgagcgtatcccgaagaacacggttttccccacctccctggaaaaggccttgagcaccgggtcaatggtacttataaagtccaggttatttgtatagttaattccaatccggtaggctgtcaggccgatggtatatctctgcttctgctcccttgccacatgaatcataccggtctgtaccagtgtggttacgatatcgtaagcgctggtcttaggcatgtccagctttgcgcatatctcgtccagggtaatgccgtccggtttttttgacaccagctttaatatttctacggtgcgcagcgtggttctgtttagtttcatggacacctcctgctcaattattcgtatatacatcttttatccgtatatacgatatctgttattcagtatacctcagtccgccaggagatgcaagaagaaattacaattaatactgccataaataatactgccataaaaaacgttttttctacagggtcactccctgtttaaagatagccatatcatggaatcctgcttcctccgacttgaccttcctgccggatgcaacatccaggacataattcagcagctcctttgccagttcttcctttgtcatgtcctccaccatgcggcctgcgttaaagtctatccagttgtccttatggcctgccagcctggaattgctggatatcttgaccgttgggaccggggaggcaaacggggttccccttcccgttgtaaagagcaccatatgggcgccggatacagccagggccgtggaggccaccaggtcattgccgggagcgcttaacaggttcaggcccttcaccttcaccggctcgccgtattccagcacacccctaacaagggcgcttcccgacttctgggtacaccctaatgacttgtcctccagggtggagatgccgccctttttattgcctggggacgggttctcgtagatggtctggttgtggcttgtaaaatagttcttgaaatgattgatcaggtccacggtcttgtcaaacagctccggagtggcgcagcggttcatgagaagtgtctctgccccgaacatttcaggcacttccgtaaggatggtggttccgcccttgctcaccagcaaatcggaaaatgcccccaccaccggattggccgtaatgccggacagtccgtcggatccgccgcacttcatgccgatgaccagctcggcggcatctatcttctccctggaaaatgcgcctgcgtaagctgccagctccttaagaagccccatggcagtctccatctcatcctccacatcctggcactggagaaacttcacacggtcctcgtcgtacgctccgatgtagtccatgagtacgggaatgttgctgttctcacatcccagtcccagcaccagaacgcctcccgcgttgggatggcggatcatatctgccagcacctttctggtattctcctggtcatcacccatctgggaacatccgtaagggtggggaaatgcaatcacgtcctccacatttccaacagccagtgactttgcctggttctccagggccttggcaatggagttgacacagcctaccgtggggataatccatatctcgttgcggattcccgccttgccgtccggcctgcggtatccctcaaaatacacatgctctgtaggggccacatcgttttcctggggaacatagtcataggtaagcacatcgccaagggcagtccttacattgtgcacatggacccacgcccccgcttcaatgtcctcctttgcatatccaatcctgaagccgtactttaccacttcctctgcggcttttatgaaccttaaggcaaacttgtgtccctggggtatgtcctctaaaaggctgacctttgctcctgccacatccagagtctccccctttgcaaggggacgcagcgcaaccgccacattgtcattttcatgaattttcacaatatcctgcatggccattcattctcctatcatctttgttttctttgattttgtgtgcctgttccttgtttgctgttttatgacttatttttgtaagtgcttacaattattctactcattatcaggtcagaagtcaataaaaaaatagaaaagtattgcattacttactgggaatatgtataatatacttagcttgtaagcgcttacagaatgtgaggttagtttatgaatatatatgatgtttctgaacatgcgggggtgtccatcgccaccgtatccagggtacttaacggaaatcccaatgtcagtgaaaagaccagagaaaaggtcttgaaagttatggacgagttgggttatactcctaatgtgttcgccagaggcctggggttaaataccatgaaaaccatcggaatcatgtgttccgattcgtccgatccgtatctggcaggtgccatctactatctggagcggggactgcgcgcccacggctatgacgccattctctgctgcaccggctatgacctggacgccaaacagaagtattttgatttgcttcgttccaaacgggtggatgccatcatactggccggttccaagttcgtggagatgcgtgccaaggataatgcctatatcatcgaggctgcttccgaccttcccatcatgctggtcaacggcttcctggaaggcgagaatatatacagcactgtctgcgacgatcacgcggcggtgtacggcgctgccagccagctgctctcctccggacgcaggcgcatcctgtatgtatacaccagctattcctacagcggggtcaataagctggaaggatacaaggacgccctcaaatcaaagggcatcacgccatccgacgaactcatccgccagtgtcccaaggacatagaggctgccagggagctgctgctgtcccttcacagggaaggattggaatttgacgctgtcatcacctccgacgactcactggccgtgggagctgtaaagtatgcccatatagcggatatctccattccccgcgttctgagcatcatcggctataacaattccctgctggcccggtgtacggacccggagattacatccattgacagtaaggtggaagcgctctgcaccaccacgatcaacactctgatgggggttttcagcggcgtgaatgtgcccagcaggaccacaatcgcttctgatttaataaaaaggaaaaccacaaatttttaattcttaaggaggaatatcacacatgaaacaatttatggacaaggatttcttattatcaactgatatggccaagacgctgtatcatgattttgcagagaatatgccgatacttgactatcactgccacatcaatcctcaggaaatctatgaggaccgcaagtttgacaccatcacacaggtatggctgggcggcgaccattacaagtggcgccagatgcgttccaacggcgtggacgagaagtatgtgaccggcgacagcacggacagggagaagttccaggcctgggcagagaccatgccaaagctcatcggcaacccgctgtaccactggagccacctggagctgaggaagtacttcggataccagggctatttaaacggcgataccgccgaggaggtctggaacctgtgtaatatgaggctccaggaggactccatgacagtccgcaacctgattaaacagtcaggtgtgaccctgatctgcaccacagacgatccggtagactccctggaatggcataagaagattgcagaggacgacacctttgatgtgcaggtacttccggcatggagaccggacaaggccatgaacgttgaaaagccggcctttggcgcttatatggctcagctttcccaggtcagcggtgtacagattactgattttgcatccttaaaggaagcgcttaaaaagcgtatggcattcttcgcatccatgggatgctgcgtatccgaccatgccctggaatatgtaatgtacgcgcctgctgctgactccgaggtagatgccatccttgccaagggtttaaagggcgaggcggtatccaaggaagaggagctgaagttcaagacagccttcatgctgtttgtggcccgggagtataatgccatgggatggattatgcagattcactacggctgcaagagagacaacaacggctacatgttcgagaagctgggggctgataccggatttgactgcatcaacaactatgctccaagtgcgcagatggctgatttcttaaatgccctgagcaccaataacgagattccaaagaccatcctgtactccctgaatccaaatgataatgcttccatcggaaccattatcggctgtttccaggagaaattccccggcaagatccagcagggatccgcttggtggttcaacgaccacaagacgggcatgaccgagcagatgacatccctggccaacttaggatgcctgggcaacttcatcggcatgctgacagactccagaagcttcctgtcctacaccagacatgagtacttccgccgcatcctctgcaatctgattggagactgggtggaaaacggcgagtatccggccgatatgaaggcgctggaggaaatcgtaaagggtatctgctacaataactctgtgaaatactttggatttaagctggatgaagtaaagtaaactgaaacagcataaggggactgcctgattgggcaatccccttttttgcactatacctctattgtcctcacgttcacaccggggaggcggattttccccttctcgcaaactgcaggaaggcggttgccagcccgcttatgcacagcattgcgtaaaagctgattcccctgcttagaagcatcacggaaaagctctggcctgcccctaaaagggtgcggtacagcacgagaaagcttccctctgaggctcccacggaaccgggaaggggtactgcggtgactgccagactcaaaatagcctgaagggccaggaaatcttttgccgatgcggatatgcccagggcacggcaggcccagtaaggaaccagatagagagcggtcagctgaaccgcactatggatgaagattctcaccgccgccaggggatactgcctcagataggctcctcccctgctgtactcatcaatcagtccctccaccttccggatggcgcgtttcctgttttttatgattccggccctgctcagtccgcctgcaatgcacagcattgttttctccgccaatagaccatggaagatgattaacaggataaggccggaacagaaaccatttaccagtactccgaagaccaggagcaaccgtatgaatctgccctgccccatgacaaaggacagattggcgcccaccataacgcacccgtaaaccagcaccgtcatctgatacaccgcggctgtggccagaagggaaaatgaactgtgggctgctccaaagccgtccctgaccatataataaagctgcatgggctgccctcccgtggcggaaggagtgatggcgctgaaataaaaatccgtgaacgcataggaaagagagcgccagtacggtaccttcttgccaaaggtccccatcaaaagcctgatattggctgcctcgcagttgacgaacagaaacatgcaggcaaaccctatggctacaaacctgatatccgccctcataaaggtactgcccagggtctgggcggaatggccgctcaaaagaacatggaatgtgaaccaggccagcaaagccaccaggcagagcccaatggacatctccttccagttcatctttttctgtttcatccctttcgccccctttccctgccttttttctgtttaagctgtgtctattataccgtccaattcttaaaatcttatgattattttctgaatgtttttgtattttttatcgcgttctgatggtcagagatcaaaaaaagccgccgcgcaatcaggattcgtctcctcttgcgcagcggccctgccgctgtggtccagactgcccatcctctatttgaggcgcaccacatgctggcagtatatgtacatattcttgatttttttggcctgctgtccgtcgtctcccagcacgatgggctgtgttcccgtaggggttatgtagagcttaaaggcgatggcatcctgcccaatcttcatggaccttaccggcgcgtactggaaattcccctgttggattcccagatattcatacatgctgtgctccaaatcaggattggcaaacacccgcaccacatctgcttctcctttcatgtcgatgattgccctggcttcctcaaatttgatgttcgtaaaacggtaatccccattaccgatgatataggccagcgtaccattatccagtaacagcaaaggatccgtctgtgccatgtaaatacccccttttcaaaaatcattcttaatatgtttcaccttaatcataaagcctgctgagaggaatgtcaatataatcagaaaattatcaatattgtttgtcaattaactatcaattcaagcgtttttccgaatactatttctctcggaaactgcctccgccgcttcccggtacagtccggcccatgggcaccctgaaacgcaaaaaagattacaggattcatcccataatcttctctttccttatatcaaaaaatgtatgtgagcaggacgataagccgggttatgtcgttgaatggccatctatctaggactgccgtcgccggcagcctcaagcaacctacccggaagctgacgggcagccatatgcttcctgttcggtcttgcttcgagtggggtttacatgtgccccgcctgttaccagacgggcggtagtctcttacactgcccttccacccttacctttaaggccgcagccaaaaaggcggtacatttctgttgcactgtccctggagtcgcctccgccagacgttatctggcaccctgccctgtgaagcccggactttcctctcccgcggccttgcggtatcgcggcagcggccacctgtcctactcacaacgtgtattagtctatcacagaatcatgggtttgtccagagaaaccatgttgcttttccctacacttttccctacacttttccctgcaaaccatgttgcttttccctgtattccgacggcggacagcctgtgtatttcttaaaggcagtgctgaaataaggaatgttgctgtaaccggtcatcatggcaatctcgtaaatcttacggttgggatcgcgcatcagatccttcgccttttccatgcgcagcttcagaagataatcggtaaaggtcaccccggtctcactcttaaaggatgtgctgaacctggcgctgctgagtcccgcggcaacagccgtgtcctccatggacaggacagggctgctgtaattttcctccatataggcaagggccttcaccaccggcctggaataaacgccggatttctggctgcccacatactggcagatacgcttcaggttttcccccagcacgccgatggcctttccaatggtctcgcatccaatcagcttcttatattcctccaccggattctcaaacaccagatccgcgcatattcccgcatctcccagttccttaaggaccgtgctgtaaaggctgccgaccatgaactgcatatagatataggaatccatcccggcctgcttaagcagcttctccagctctcccatacgctttttgagaagctggacattgccgcttttcaccggggtgataaggtcgatatccagtatgggagacggatcgctctccttttcatcccccttgatatcctggaaacgcagattctggttgtcgcctctgatgtattttaatttcagggcctcatgtgcctcctggtaacactggtccagcagccggatgccccactgcacattgctctgcgcgcaggtcaggctcatcccctgttctgagaacaactgcctggtatggcttataaaaaggcttgcgcgcatttccactgtcatcctggtgggcgcaatgactgcaatctcacagaggttctccctctgcaccagcacataggccccctgttccctcatatggccggcggcttccgccataagccagccgctgtccgcggattcaaagataaggaccatacagtagtcatgctccatctccgttatcaggccgctgtcgcttacctcatacatgagaagcttgcgcagcaaatcctccctgtcctcaaaggagtcctttctggcctcgtcgaaccgcctgacgcagtctgatgccagataggtcagctcatccatgttaatgggtttggtgagataatcctgaacccccagcttaagggcccttctggcatattcaaaatcatcataaccgctgaacacaatggccataagccccggattcagcttctttccctcctctatgagctgcagtccatccacatggggcatacggatatctgtcatgagaagctccggccgctgttcctttaagagcgccagaccttcctttccgtttccggctgttcccaccagctctatgcccagggatgcccagtcaatgacgctgcacagcccctttaaaattatctcatcgtcatcacagataatcgctctcatcggatgtctcccccttttttccaatccgcagggtcaccacggtcccctcacccatggcggactctatggtcactccatacttgctgccatatacaatttttatcttgtcattcacattgcgcaccccgtaaccggtgccctgctggtccgaggatatggtatccagctccctgtttaagcgcctgcatgtgtcctcatccatccccatgcctgtatcctgcacctgcagaatgacatcgccttcctggggaaagatatggatataaatatatcccttctcctccatgggcttgattccgtgatagatggcattctccaccaccggctgtaatatgagtttgggcgtcctgcatgataaaatggacggatccacatggatgtcatagtcaaatttctcctggtaacgccggtgctggatgctcagatagcttttgatgtgctttacctcttcctctatggtgatgatatcccgtcccttgctgagacttatcttgaaaaagtctgtcagggctgtcagcatctctatgctctcctccacctgacgcattctcagcgaccagatgatggagtccagggtattgtacaggaaatggggattaatctgggcctgcagggcctttaattcctccctccgcagcttctcctgttcccggtatatggtgtcaatcaggtttctcatctctcctgtcatatggttgaaggaatcatacagcacccctatttcgtccccgcgctctgtttcaaccgatgtttccagattgccggcgcagacctgctccattgcctttaccagtgtaaataagggcctggtaacggaatcagccactatttcggacagtatcatggatatgaccacggccagcgccaggagcataatcatgagcaccttgatatactccacggaccgggtaatggatgccttgggtatgacgcccacgattttccagtccgtctgattcagggtctggtagaccaccagctgtcctttgtccttcagcacatgggatacgccgtattccggtatttcacttaaattttcctccaccatgcggcgcgccttctcaaccccatccctgtccttccatggtccttctcccgctgtcagattcatgatacggttccgttcatccatcagaaacacgtcccctgcgccgctgaccgccctggccgcaatgtcagacagcttatcggaatcaatatccgccaggaccacccccttggtccggcccgtggccttatcaataaaaggaattcccatggatacataagaggtatagggggtgctgactacataggaattctcatggggcggaaaccattgggcctgtcccgtggcgtggatgattcggtaccagtccgtgtccctgggatccgacaccagaaaggatgatgaattgctcttatagcgccctccattatcccccagcacatatacgccaaagatgtcccggttataggagggaagcaccatcatctccatgctgccctccaaatcatgggaatacatttcctttatggagctaaactgacgtcttatgagcttctgcatgctgatattgtcattcatggcggaacatacctgaaaggtctggagaaacagttcattgatatcctggcatgcattgcccaccatctggacggtggtggcctccgcttcctcaaggattctggatgaggtcatataatagtggagggcgccggtcagcaccacaatgccggttgatgcggcagcaaaggaaagaatcatcttttcctttagcataaggcgcgcacccaggttccggcaggccttaaagcatgtccgcttattcagatatgccttcatggttttcttaatatgcatcttcaaacaactcctccgcgttatccatggtatattcccggtgtttcaccatggtctgccggtccgggtcttcccccctctggtgcctgtttatgatatcaaataccgcatccccgtattccggactgctctttaccgtggccagatactcccgggcaatgatagccttaaacacatcctgtatgccgcctatggacacaataaccacatcctcacccggttccatacccgccagcttaagggcctggaggacccccagcccatcctcgtcgctttgggcaaataccgcgttaaaatcaatgtcctggtccgcaattacggactctgtcaccttctgggccgtgaggcggtttccactgctctccacacgcttggaaacatataggttggagtgctcccttacgccgtgcatgaatcccatgtaccgctcccaatccatggccgaggacttttccccctgtatcaccatggtatggcagggctcaatgccgaaatgacgggcaaggatgtccgcacacagctctccctccgcataatagtccgaggcaacatagcccagtatgtaatcctctctgtcatactccggctccatctccacatcctgttctgccagtatcaccggcactcccctctgcctggcctccaggagtacctggtcatagccgtttctggcgctgggaatcaggataagataatcaatacccgcatccagaagaccgtatatatcctcgatctgccactccaggctctcttcctctggcgcatggtaaatcagctgcgcccctcttctcctggccgcctccttaaagctcttaatctgagctgttttccagggcgtcagaggttccgcctgggataaccccactctcagtccctcatgctctgtctcctgtacggccggaagggaccatctgtcctttaccagccataaaaggcatgcaagcatcactgcaaggcataccgcaatgattttctttctcatatgtcaatgcccctgtctcaattgaatcctattttgaatcctattataccagaaaagcacgcaaatagacagacaagataaaaggagggctgccggagaataacccctccggcagccttcctttttcatattctcttgcttttaatagaacaggttcaccagtccggtggagaacaccggaacataggccatcagcagcatacagataaacagcatgacatagaacggaatggattccctgatgaacgcctttatcttacacctggtgatgccgcaggtgacaaatatcagggcacccatgggaggcgtcacgccgccgcaggccattgtgaatatatataccatggcaaagtggatggggtcgatgccgtaagcctcagccaccggagccagaaggggaaccagaacaataagggctgcgtttccctcaatgaacatgcccaccacaatgaggaacaggataatgacaaagaggaacaggtatttattgtggatggttcccagcaccagcgccgtaaactgctgtggaatctgctccctggtcagaatccaggcaaaggcagaggcgccgcctacaatcagcatgatggatgccgtggtagccacggtctccttaaggcccgtgccgatgtccttaagcttcagttccttatataccacgcccagcaccagggagtagacaatggccaccgcccctgcctccgtgggggtaaagattcccaaacggataccgccgatgatgatgacgggaaggcacagaggaaggaaggcgctggcaatctcaggagctgcctgtttcatggtcagacgctctgtgcgcatgggcttatatcctctctttttggagataaagtgcaccagtatcatcatggcaacacacagaagcacgcccggtccgatgcctgctataaacagttttccgatggaaatattggcaatggagccgtaaagaatcatggcaatccccggaggtatcaggggtgtaatcatggatgacatggctgtgaccacagtggagaactgcttggaatagccgtggcgctccatctcaggcaccagcatttttgcctccatggcagcgtcagccagattgcttcccgacagaccgcccatcagagtggacaacagcacatttacctgggccaggccgccggtcatgcgcccggtcatcacattgcagaatcccataacccgcttggttacgcctgaataattcataaacacacctgcacagataaaaaacggaatcgccagcagaggtatgctctctacgcctgccaggactctctggcccaatatctttgtaaagggaccgcctgtcaggtaaaaatatgccatggaaccggaaagaatggagatgaacaccggaaccttcaggaacagcagcaccagaagaactaccgtcgatattaaaataatacttgtctccattgtttacacttcctccccttttcctgttaaatccctgtatgtattaagacatacctgtaccgccatggtaagacatcctatgggcagcggcgcgtaaataagactgtagggaatcttaagaatgtttgtcacacggtcgtagcgcaccatctgcatgatataccggactccctgatatcccacatagcagaggatgatgactgccgcagctgcaatcagcacgctcagtattttctgaagcttttccgggaacatctcaacaatcacgtcgatagccgcatggttcccgcacacaaatgcatacctgccccccagaaataccacccatatgataagggccagctgcacttcctcctgccatacaaagggatctcccaggcaatatcgcatgatgaccccgaagaatgtgactcccaccagaagtaccagggccccgcaggctgccagcacatccgcgttgcggagcagattcccaatcttgttatctgatttcataaatatttacccctttcccggtaccttaatcctgcctgcctataatagccttcatttcctcgataagcccctcggaccacatggccttaatctgcggatcctcgtaaaatgcctggcctgccgccttgaaatcctccggcgtcagttcgcttaccgtcacgcccgcatcctttaaagcttccagcgcttcctcatccgccttttccagttgctggctgttgaatacgccggcctggtctccgcactccatcagaatattctgctgctcctctgtcagtgtatggaagtaatccgcccccataatccagcaggtcatgtcatatgtatgggcatccagcaccaggtttttggccacctcctggtatgcgccgtttaagataaccggaagagggttctctgccccgtctatggttccctgctgcagggccgtgtagatatcgctcatagccatgggtgtgggcgttgctcccagggactcaaacactttaatcagtatggtctggttgggaacacggatttttttgccctttaagtcgctgaccccattcaccggctttttagtgatggtatggcggattccgtatctccatgtggtcagtatcttcagtcccacattctgttccagctcctctgccttgccctcaaaccaatcgctgtccaccaccttttccaggtcctcccatccctcaaacagatacggggcaaagagaacgccgaaatcctggattcccctgtcctggaaaaaaggaccgttggccagggtgaccacgcagtccccgtttacagcctggtcgatgatattgtccttgcttcccagctggctggaaggatacaggtccactctcatggtacctccgcttttctcctccaccagtctcttccactcatgacaggccaggtcaatgggttcccccggattgttctcatagccaatcatgatgcggactttcttaccgctgccctctgctgtctgaccgctgtccgtctggctgctgcatcctgccagggataaggccaatgtgcagcttaccagtaatgccagtaccttcttcattacttcccctcctgaattcttattccccgcggccaagccgccggatttatgttttctcgtctttaatgcccttattatatcgttgaggcaggtgttttgtacattcactctcattcctttttcttttaaaatctttccctcacagaattaaaactaaaataagcgcaaaacaggcgcaaaaaaagaccgtcccctgtaccgtgattgtaaggaaacggtctgtctcgtctcagtgcctttccgcggacatcacacgttcaggcagctcccgccgataaactccctgagaatggaattctttggaatatcctcgctgctgacaccgataaagtagtccaggaatttaaggagccgtttggcctccagccactcctcactgtcctttggaatggcaaatagcaggggctgggcgtactgtttcagcactgccagctcatagaccagggcagagttgaacatggcgtccgcctcctcctggaagggaaagatattctcctcctcccccctgcgcacagaaggccacatgcggatggtctcctgagccgaggagcctcttgtcctggcatcccgcaccattcttctcagaagccgtccgtccgtggtgggaatgcggttgtgctcgtcaatgttgagctgggtcagggcgctgatgtaaattttaaatttgctgtctgccggaagggtgtaggaaagcctgtcgttcagacagtggatcccctctatgaccaggatatccccctctcccagctggagaaaattccctttgtactccctgacgccctttttaaagttataatagggaagctccacccgctttccctccaaaaggcctgtcatgtcacggttaaacagctccacatccagacattccagaatctcataattgtaattgccgtgttcatccctggggctgtccacacggtttacaaaataattgtccactgcaatgggatggggctttaaaccgatggcctccagctggaccgacagacgatgggaaaatgtggtcttgcccgatgaggacggacccgcgatcataacaaagcgggcgttcttcctggctgctatctgagccgctatctcagcaatcttcttttcctgaagggcctcctgtatcaaaatcagatgggacatatccccctttgcaatcctgtcattcagggcgcccactgtctccagatccatccgccttccccactccgtggattcagacagggtggcgaacagcttatcgctgggcgtaaaccggtggaggacgtccggcgttttcctgtcaggcattaccatcacaaacccgtagtggtagggaatcaggtcaaaatgcttgatgtagcctgtattctgcaccatatagccgtaatagtaatcctcaaagccgtcaatgctgtaaatgttgaccctggacaccatgcggtaccggaacagcctggccttgtcatacatccccagcttctcaaaaagctcaatggcatcgtccgtggatacgctgcgcttcataatgggaatcttccgctccacgtactccctcatcttagcctttaccgcatccaggaattcctggttcaggacaaagtttcccctggcctccacaaagaatccccggccgatggaaaaatcgatcatcagcttttccacattgccggctcccgccacgctgtagaatgccttcagcatcataagggacgcactcctctgataggcggacattcccggcttatcctttgcggtgacaaaggacagctcacagtcctttacctgtttatgcagctcctggagctttccgtttacccgtaccagcagaatgtcatattcatactccttctggtgctccccggccacctccatccatgtggtgccctccgggtattcctttgtggtgccgtttatcttaaccagtgccattccacttacctccctcattttactgaaaacggttttcctgtcacacaatcatggctggccactggggcggcgcctgctccagctcaacctggcttcccagattcttcctgagaaactcagccatataggggatgaacatgtgctccaggccatagtggcctccgtcgatgatggccatacccctggctgccgcgtctattccctggtggtggctgatatcccctgtcacaaggacctgggccccccaggccagggccccctcaatttcgcttccccctgctcctgggcatacggatattcgggaaatcttctgatccataagttcgtccccgtatacaagggcaaagggaaggccgaatacatcctttacacggaccgccagctcccttacagtcatttcctcctttaagaatccgcttttgccgatgccgtaggaaacagcaccctccgggccgctcatctcccccagtgcctccagaggaacacagccagccaggcccagccgttctgcggccaaatcagccatacagcccggggcagcatcaaagttggtgtgcatggcatagtaggaaatgtctgcctgtatcagtttcaccagccttctggtaatgaagttctgatcatttaccttcttgatggccttgaatatcaggggatggtgggtcaaaagcatatccgcccccaaagcctgtgcagcctccaccaccttgtccgtggcatccagggcaatgtatatcttttttacttccttatcgcttctgcctgccagaaggccgggattgtcccagtcacaggcgcagtcctccggcgccagtttcctgcatacgtccataatctcactgcatttcatcttgtgcctccttaatccaggacagttccttctgcctgcttattctggcctctgccctggtctctgtgtcggtaatcccatcttttgcctgaaggctaaccagaattttctcaattctgagcatctccctgcccagatattccctcaggatcacatcctttttatcaatcagaatctttccgtaaaggtaatgggcctggctctcatactccatgaagccccttttcacgctcatcaccgtatagtattttccctcgtcctttaccatggcttcatcctcaatggcaaaaccatgggcggccagataacgccttaccttatccaagtccgactgcggcgacaggacatactgttttacgctgtcccacacatggcggccctcatccaggatttttataatcagctcaccgcccatgcctgcaatgataaccgtgtccgcctcacccggtttaagctcctttaaaccgtcactgagccttaaatgaatgggaaccgcccaaacgtcctgcctgcgcgccctctcccgctcctcataatcccttacatgggcctgagccctctccaggggtccgggtctaacgtccatggccagggcagaagcaatacgccctgtctgggccaggtatacgggtatataaccgtggtccgtacccacatcggcaatacggctgccctgccttacaaaaccggctacggtcaaaaggcgggccgacagttttatggtccccgcctgttttcttttatctcttgtctctaacttgtcactattcatccagataatcctttaactttttacttctgctgggatggcgcagcttgcgcagggcctttgcctcaatctggcggatcctctcccttgtcacattaaactgctttcccacttcctccagggtcctgggacgtccgtcgtccaggccgaaccgcaggcgcagcaccttctgttcccgctctgtcagggtcagcagcacttccatcagctgttcatgaagaagggtaaaggctgccgcgtcctggggcaccagcacattgtcgtcctgtatgaagtctcccaggtggctgtcctcctcctccccgatgggggtctccagggataccggctcctgggacatcttcataatttcagatacccgctccaccggcaggtccagcctggccgcaatctcctccgtggttggctccctgcccaactcctgcaaaagctggcgggaggtgcgcaccaggcggttgatggtttccaccatatggaccggaatccgtatggtcctggcctggtccgcaatagccctggtaatggcctggcggatccaccatgtggcataggtgctgaacttataccccttggtataatcaaatttctccactgccttgataagccccaggtttccttcctggatcaggtctaaaaactgcatccccctgcccacataccgcttggcaatgctgaccaccaggcgcaggttggactctgccagccgtttcctggcttccgggtcgcccagctccatcttcttggccagctccacctcgtcctccatgcccaggagaggaatctttccaatctccttcagatacatgcgcacagggtcctccaggctgacgccttcgggaaccgacaggtccaggtgttccacatcaatttcttcctcttcatccagttccatttcctcctcgatgaaaaggtccgggtccagctcatcctctgttcccatgcggatgacatccaccttattctggtccaggaactcaaagagcctgtccaactggttggagacagggggctcctgaccgaaatagttcatgacctcctggtattccaatacatttttctttttcttggcttcctccagaagtcctgccagtttctcctcaaacacgtccgtcccttccataacttggtccatccttcctatgaaatgctgtcaatccagggagatgtgcagctgctttaaggctgcctgctgcctgataatctcctgtaactgggttatatcctttgcattgcggctggccacatccaggctgttctttctgaccttcatcacagtctccgaaaatgccttcttttgttcttcattgttcagggattcctttaaactggcgttaaacagggccgccacctccttgtactggtcctcatcattgataaaccggctgagtatggctgctgggtttaaattcccctccctgtgtccgtcaaataccatctgcgccacctgatgatacaaatgctccacaaaatcatctgctgttatgatgccctctatcttctcaaacagggccggggtctctatgagccaggtgagaagcagtctctgggaacggcggattccatcctccttatccggccgcctgggtttacggctgccggaaagtccgctgccgccagattcctcctgtgtctcctggggcaccacacggccggaatggttcaggctttcacctgccttaagccccatggacatgcccatgcggtttaccaggcctctcagctcctcggccggaatcatctgctccctggccactgcctggaggtagttctcacgctccagtgcctctccaaactggagaagcttcctggccgtctcctggtagaacctggtcttctgctccggatcatccatctcatatccccgccgcagtacatccacttcaaagagaaagctgtttttggcttccctgatccgctgccggaaagcctctgcccccatgttcttgatgaactcgtccgggtccttatagggcttcatgttcagtaccttgatggacatacccacttcctttaaaatgggaatggccctcagcgccgccttcaccccggccccatcgctgtcataggtaaggattacctggtccgtgtaccgtttcagcacattggcgtgctggctggtaaaggcagtgcctaaggacgccactgcgttggtaaaacctgcctggtgaagggatatgacgtccaggtacccttcacaaatcagtagatatccttccctggaaagcctggcataattcaggccgtagagattgcggctcttgtcaaaaagttttgtttccggggaattcaggtatttcggctccccatcccccataacacggccgccgaaacctatgacacggttgttcacatccatgatggggaacatgacgcggttccagaacttgtcccttccgccccgttcctccagcgtcaccagacctgtatccttaagaaagctgtcctcatacccctttcccttcagatagcggtacaaatcatcgctggtcttattggaataccccagtccgaaatggacgatgatctcatccgccagtcccctcttaagatggaaataatcataggctgccttgccctggggctgtttcatctgataatagaaatagtttgccgccagcttgttcacttccagaagcctggccctcagatccgcctgctccctggcctcgcggctgtactccattttcggcaggttcacgccggccctgtcagccagggatgaaagggcctcctggaaggtataattttcatattccatcagaaaggtgatgacgttaccccctgccccgcagccaaagcaataatacatctgcttccccggcgatacggaaaaggacggggatttctcattgtggaaggggcacaggccgaaatagttggccccctttttctgcagtttcacatatcctgaaatcacgtccacgatgtcattcttcattctcacttcttctatgacttcatcgggatagtacatgcaataatctcccttctgtatcttttaatgccggctgtccaaatacagccggattgtcagtacacgttccaccgctttggaacgaataattcctcaaactggtcaatggcatagatatcgctcatgccggcaatgtagtcgcacaccacccgggatttcttctcccccttgttaaccataagaagcacatactccaccggcagcttatccacatgccccatataatactcatagagctgggtaatcatgttctgggcctttccctcctccgccttgggtatatcgttcttgtatacattgtcaaacatccatttgcgcaggccctgcatggcctcctccatcccctccgacatggtaatggcaggtttgtccatgctgttcagtatgatgtcgtgaatcatgttgttgagacgttcccggacactgtggcccagcacatcggtatacaccctgggcagctcatgctccgtgaacatcctggcccggatggcatcgtctatatcgtggttgatataggcaatcttgtctgacagacggacaatggcgccctccagggtggagggatgaccggaggtcctgtggtttcgtatgccgtcccgcacctcccaggtcaggttcaatcctctcccgtccttttccagcacctccacaatgcgcacgctctgctcatagtgggtgaatccgtcctcgcatatcttattcagtatgtattcaccggaatggccaaagggcgtgtgccccagatcatggcccagcgcaatggcctctgtcaggctctcattgagccgcagggtcttggctatggtgcgggctatctgggatacctccagggtgtgggtgagcctggtcctgtaatggtccccctcaggcgccagaaacacctgtgtcttgtgcttcagccgtctaaatgccttggagtgaaggatgcggtccctgtcccgctggtactcaggccgcatatcgcacagctgctccggcttgtcccgtcccctggtcctgctgctaagggacgcataggggctcatgtacgattcttccaatgcttccagtgactccctgatattcatccatccactccctatctctattattatattgtcggattcctgtttttactacaaaaatttcaaatattgcgtaagcaaaagagcatcaggccggtaaacagctgcctaatgctcacattatatcataaattctaactatttcctagaggcagactgtccctcacacaaagggttccataccccagcctctcattgggccacacatcataccccggcagatgcctggcccctctggtaaaatacgcctttaccttctcgccgtacagaaagggatcgttgccctgtaatattccccactgcatcagcagggccgcgctgcctgtgacaaagggggctgcaaaggaggttcccgtcactgcctcgtatccgcctccccgcctggctgtgacaatatccacccctggagctgccagatccggttttacctggcctgtctggcgtgtgaaaccgcggccggaaaaatccgcgtaagcgcggtaagagtcatcgtaagctcccacggatatcacattggcagctgtggaaggaatggtcagggtggtctccggaaccggccttaagaagcgggtggaagggtttaaaatccccctggacggcagccacatatcgtaccgtccggtgacaatccgctccggcgtcagacggaaggtccagataccgctgtccagataatccctcacaggcaggaaatcaaagtatacctcctgggccctgctgaaagggctgggcttgccgtaataaatcaggatctgcgttcccccgtagcgcagggtctggggacccagccggctgtcgatgggcccgataatctcccctgacggcgtaaccaggcggatggaaaactggtccacataggacttccacagctgtactcccatccctgtctcataaggcgcaatggacagctgcgcattttcctcctgccccataaccaggcttcctgccctgtgtccggccccggttccctcgttgcccgtgccggccacgatgacattcctcccgatgcctgacatgtcattgatgaaggtttccagcagactggtcccgtcatgggagccgtaggtatttccaaagcttatgttcacagccaggggccggttcatatcctgtgcccgccggaccaccaggtccagggccttcatcagctgggtggtacgcggaaagctgtccgtcaggggtgttcccagctttaccaccataagctcgctctcataggcaacaccgcggtaaacaccgtttccctccctgccgttgccggctgcaatggcagccaccgctgtcccgtgtccgctggggtctgtggaaggcaccagggccagggccgatgtccggcttccggtttccagggcggcgttgatctcctccctggtataaatccggtccctgtcctggtctgccagcagcccgatacgggtggttccgtcgggatttctgaaatccggatgaaagtagtcaatgcctgaatcaatgacagccaccagcacgccctttcccgtgagaccggattccaggctgcttatgacgccgccccccgccccccctgtaccccctcctccggcccctgccccgatgctggtctgaatcgtgcttagacaggaggctgcccttgccatgttgctggcaaagaacagcctctttggtttctcgatgtatacaatttgctccatggcgctgacctgttctatccggctctccggcaccaccagaaccgcatatccggctgccagctcatccacccggatgccttcatcacgaagggattcgagtgagccgttgtacctgactataagctcccaggtcttttccccggggtcataccccacattcaggttcactgatttcagccgttcctcctccgtggcatccagggccaggttcagcagattttcccgtttctgattatccatatggacgcacctcctctacccatatgtgtattcctatccccgcacaatagaataaatactggcaaatcccgtcaatgtaactgccgccaccagaatcggggtgagaaaacggatacagaatatccacagctttttaagcctgaaggtgacgccgtttttctccacctcgtccaccagataccggggattccatttccagccgataaaatagcacatggccaggccgccaaatggaaggaggatgttgtctgtcaccattcccacaaagtcaaaaacgctgtaattgaggatagtcacattccccagggtgccgaaggacagggcgctgggaactcctgccaggaaaatcaggaggcccaggatgaccgtagcctttttcctggtccacttaaggctgtccactgcaaaggagaccaccacctctaacagggcaatggcgctggtcacagcagcaaacagcaccagcgcaaagaacaggattgcaaagaccgcccctcctttaatggaggaaaacacctttggcagggtgccgaatataagccccggcccctgtcccggctccagaccaaaggaaaacactgccggaaagatggcgatacctgccatcactgcaatgatggtatccagtcctgccacgctggcgcagcttctgggtatattttccttatctcccagataacttccgtaggtaatggtaattcccatacagaggctcagcgaataaaatacctgacccagggctgcgctgaccgccttcatattaaaggctgcactgctgggaataaagataaatttaaggcccaaaaccgcatccggcagggtcacgcttctcacgataattacaatcagcagaacaaaaagcaggggcatcatgatcctgctgacattctcaataccgctgataccgtgataacagacagctgttgttatgaagaggaacagaaaatgccagaacaccggctccaccggcgcgctgataaatgcctcaaaatcctccggggcgtgaaaggtggtaccatagcttacaatatacttgataatccagcctcctataacactgtagtaggacagaatcaggaatgccgcagccactccgaatacccccgcaatcctggcattggggtggatatccccgtatgcctgcacgggatcgtggcgggtctttctgcccagcgacatctccagcatcatcaccggtacacccagaatgcagataaagaataaatacaccaccaggaaggacgccccgccgtttcgtcccatgaggtaagggtacttccacaggtttcccagtcctatggcagcccctgcggttgccatgataaatccaagtttactcgcccattgattcttagtcttcatgccagtacctttccgtgtctctttttaatgaatatgaataacagtccgctgactcccatgaggatgggataaaagcagtagggaatgatttcaaagggagtcaggcctgtcaggctggctgccgccagaagctgggccccatagggaatcagtccctgtcccatggagctgaacatgtccaaaagggacgcggagcgcctgggcgtcacgccgaagtcatcgctgatctcctttgcgatgggaccagccatgacgatggccaccgtgttattggccgtacacatgtctaccagcagagccagggcagcgattccaagctctcctccccgttccccgttaattctctttttgatgaaggaaagaatgaaggcaatccctccgtactcctttaccagggcaacgatacaggccacaatcacggatatcaccgtgatatcatacattcccgtgattcccgctcccacatgggtgaacatttcccccaccccaaaggcacctgtggccactccggctatcaggctcagcacagtgccggtcatgagaaccagaaatacgttcacacctgccagggcgcctgcaagcaccaccatataaggcaccacccgcagcaggctgtagttaaggctgccctgtatgtggaatgaagcgtcctttcccaggatcagaaacaaaaggattgtgacaatggctgccggcaatacgatgagaaagttctctctgaacttatccttcatctcgcagccctgtgtctttaccgcagctatggttgtgtcggatatcatggacaggttgtccccgaacatggcgcctcccaccacggcgcctgcgcagaccgccatggaaaacccggttttctggctgattcccaccgcaatgggtgccagggccgtgatagtacccaccgaggttcccatggatatggatatgaaacacccaatgagaaacaatcctgccacagccacgttggagggcagaatggacagccccagattgaccgtggaatccacgcctccggcagccttcacagcgcctgtaaaggcacctgctgccagaaatatgagacacatggtaatgatgttttcatcccccactccctgtgcggccagcttaatcttttccgcaaagcccagctccctgttctgcacaaaggcagccagaagcgcaattaaaaaggccacaatggccggcatactgtaaaaatctccggtaatgaacccggatcccaaaaaaatcagcagaaatatcagaataggaagaagggccgctgcccttccctcacgattttcccccatgttttgaccccctgtatcaaatgctggcgtatctcccgtatcatatcccccggtacatacgcaagctgcggcctgttgggccgcagcagctttatccttgttcaattgttccatatactattttaagaagccgttgacaatctgggcttccgcctcttcctctgtaagacccagggtcatgagcttcacgatctgctctcctgcaatcttgcctatggctgcctcatgaatcagggccgcgtcaatgttgttggctatcagtcccggaatggcaaaaatcttggcatcgtccatgatgattgcgtcacattccgtgtggccgctgcactttgcattgcccacgatcttggaattaaaggtctgctttgatgtatccttggcaacggagcgtgacaccacatcggcgctggaatcctctccgttcagattcacaatgtaagtactctccgcattctggctgccgtgggtcagcagacgttccctcactatcagcttggctcccgcggccagctctgcgcagttggtcctgttggtggaatccactccctcaatctggaccatctccatctccatgtagctgttttcctccatgtagacttccgtgcccggattcaggatacgctttccgttgccgtcgccctctccgtaatgcttctccacatattttactttggcattctttcccacaaagaaacggtggattccgtcatgctccgaatcctgatctccgcagttatgaataccgcagcctgccacgatgaccacatccgcgtcctcaccgatgaagaaatcgttatagaccatctcctttaatccgctggcactgaccaccacggggatgtgtacgctttcgttcctggtgccgggcttgatgcggatgtcgattcccggtttgtctgtctttgtgacaatgtctatattggccgtggtattgcggccggctgtctggccgttggcccttatattataggcccctgccggaacaccgtgaaggtcggccacttcctctaatattctctcctggatgctgtctgccatatcgctcactcctcccctcactgcgctgtctcataaaatttactgcaggcgtccactgcggacgcagtgcccatgatctggggcatgatttcatccctggtgccctggttcactacctttccgtccgcaatcaccacaatctcatccgcaatgttgaggatccgctcctgatgggatatgatcaggatggaaccgttggtgttctgcctcatgcgctcaaacacctgaatcaggttctggaagctccacagatcaatgcctgcctcaggctcgtcaaacacggaaagcttggaagccctggcaataacagtggcaatctcgattctcttgagctcaccgccggacaggctggcgttgacctcacggttgatgtagtccttggcgcaaagccccacctctgccaggtattgacaggcttctgataccgtcagcttcttcctggcggccaggcggagcaaatcaatgacctgcacgcccttaaagcggacaggctgctggaacgcaaagctgattcccaggttggccctgtctgtaatactcatatctgttatatcctgcccgtcaaagaggatgcgtcctcctgtgggccgctcaattcccatgattagtttagctgtggtggactttccgccgccgttggggcctgttatgaccacaaacttaccgtcgtccactgtaaagcttatatctttgatgatacctatttctcctttttcatcattcacatcaaaggagagattctctaaagtaagcatgatgttccttcctctcttcttttctttcacacactgtactgcttattttaagccacaacttacagtatataccatttcctactaaattactatcaaaactttacctcttatggtggaatttgtctgttgcaaatacatcagaaaccaccggattccaaaaaaataccgggaacgcaaaaacaggaagccattcagcttcctgttccatgaaccagtgcagaagatgggagtcgaacccacaaggtattactaccacacggacctgaaccgtgcgcgtctgccaattccgccacttctgcgttacgctgctctcgcaagcaacgtaggttattataaaggatgatttatgatttgtcaattacttttcggcaaaatttttcaaaaaatacattcattggaaggggccgggaaaaatagtaaccctggcccagctcacatcccatttcccggagcatcttaagctcctgggcggtctcgattccctcgcacagagaagtgaagcccattttgttggtcatctggatgagctggcccagaaactcccgtcctcttcctgtcttggtacaggactgaacaaagccgcagtccagcttaatcacatccgtgggaatgtcggccatcatgttcataatggaataccctgacccaaaatcatctatggacgtgatgaacccttcctcctgaagggtcttcatcacatggaaggttcgggcggaatcactgagaaaggcagtctctgtcaattcaaattccaggtatttgtggtccaggccgcaggcccgggtaatctccaggatttgaggtatgagctgctctgacgcaatgtccacgcttgaaagattgacagatatgggaaggggctcccctccctgttccatccactggctcaactggctgcagaccgtcccgaacacataggtatccacctgggtgataaaaccatttttttcaaacagcgggatgaaatccccgggcggaacgattcttccgtcctcatgctgccagcgcaccaaggcctctgcaccgacgatccccaaaccatccagtcccaccttgggctgtagatacaccttgaactcaccgtgcttcagcgcgtactccatgcggtttatgatttcattttcccggtagctgctgtcaaaggggccgtcattaaagaccacggaggtggagcggataatatagtccactgatttcctggcaatggtggccctgtccaccgcagtctctatctcccggcagtccttttcaataaaatagatgccggaacggatcatcaggtttatgttggggtaaatttcattctccatccggcagaattcattgttcaggttctgcaccagattcacaaagtcattgcgtcccagcctgcacaccccgaagcttaaaaacaggtccgcgctgacgcgggtataccggtttgtctccatgccgttctgggtcagcatgtctccgaacatacgcaggatattgtctccctgggtataaccgatggcctcgttaatgaatttaaagcctttgatatcgctggccaccagtacgtactcttccttgccttcatccatcagcatctggcatgactccttaaaccggtcatacctcataagccctgtaagcgcgtcgtgattcctgtaatactctgcctcctgttttgcttcaatcagcaaggatgtgttcttgatgcctgaggcaacgatacgggccatctctgaaaccgccgcgcagtcagcccggctccactcccgttccgtttccgtgttcaccagaagtatcatgccgctgtacctgccctctataaatatgcctgcggacagcatggtatgggcccctgccctgtctaaaatccgctttaaccccgcattgtatgtctcatactccctgcgcctcaggacagcaatgccgttcccgtcatagagatggtagaaaatgtaaaactcctctctccgaaagctgtctgtagggtcatacaaaaaagcagtcctgtcgtccacccactgataagcagattgtttcccattgcctccctctccgttcatgtagagaacaatccggttcagatggaaccggttgcccacaaatcccatcaggatatggatagcctcgtcaatggtggcggatttctcaaatacctccagagccacagccgtagtggtcttgtcctccaggctgctctgttcccggcgttttgccgccctggcctgtctcaggcaatcataggaaaggctgccgttctccctatcctctgccccttcgtagaaaaggattcctccctttcctgaatttttaacctgcaaaagggcctgatttgcctttacaatgatatcagaaaagttccgctccccctcgcctgccaggcagacgcctatactgcagctaatccgctcctttttgctgtccgtatccgacagtatgccgccgatttccctctggatggttctgcccaccgcagacgcgtcttcccggttcgtattctttaaaagcacaagaaattcgtccccgccaaagcgggcaatcaaatcgccttcccggcaagcctgtttcaggctgttggccacgttcatcagaaccacattgccaaagagttttcccttttcctcattgattcttttaaaatcatccatgtccagaataaacagggctgttgtgtacggcgcgggacctgtttcaatgtattgctccgtctgctcctggaacgcacctgctgtcagcagattggtcagggcgtcaaaagcgcctttgctgctgcctcttacctttcccgacgtctcctccagcacgttctgcaatgttgcaagcctttgcttcagtatccgctgggccctgtcctttgtgaggaagattcctattaccctggccacataggtcagcaccgcaatctgttccctggtccactgtctgttttccctgcactcgtcaaagcccacaaagcccaccatatggccggagtcatagataccgcactgaagcagggaacggactccctgtggcttcagcacctccctctgattcctgggaagatggtcgatatccatacagaagaatacgccgtcctccccaaagttctccctgtagccgtatgcgctccactcataggacatattctgcagcttatccttctggggttctatgccttcattacaccattcaaaggtattatccatggccagcccgtccaggcagtcctcaaaaatgtaagccctgctcacattaaactggagtccgataattttaagaatggtgttgatggcctccctcaggtccgtggactcgtacaatgccttgaacacatagtggattaccttgtttgtcacaaaataacggccgttttcagaatcaatcatagtgccgtccgtaaatcttccctgtatgtgttttccgctgtccgcaggccttagggatgaatcgtaaaccacacagcggcccttgccccagttttttcctgcataaagagccatatccgctttcaggaacagctgctcgtatgtgctgccgtccgccggatacacagcggccccgatgctgcagctcagcttgcttccgctcttttttacagagggaaggccggcaatgtcttctatgagctgcctcccgcgtttcatgatttcttccctgccggagagctgttttgaaaataccaggaactcgtcaccgccaatcctgcccaccatatcctggctgtcaaaaaccccggcaatgcacctggctgcctctgtcagcacgctgtctccaaagagatggcctttggtgtcgttaatctccttaaaattatccagatcaataaccatcagagttccttccggcgctctgctcccatcctgcatataccggttcacagactggaccgcagcatccctgttaaacagtcctgtcagcgaatcccgcatggacttttcccagtactcctgcttctggttctgagcctctgtgtcatctatcatcacggcatggacccatttactgcccctttcgtcctccacaacgcggccgcggcagtccacccaacagatacctccgtccttagagcggatcctgaactgggccttaatgatttcctgccccagacgaaactgctccagcacctcatccagaaccctggtataatccctggcatccaccattcccttcagagtccctccggtcagctcctccagttcttttgtgtccgcacagccaaaaagactcagaagttcgtggttaaccatatccagacttctgtctttgtccgcacagcagcgaaaaaaacctgcaggcatggaatcattcagcaagataatctgctcattcatatatgctgtccatcctttgtctctctgtcttccttttcttagcgcccctgtcttttgcgcgttaaaagtatatgccttgattatacttcactttccaaagacttacaatataaagaaacaccataaaactcggcaaaaacaactgccggcaggtccaattcatcctgccggcagtcattcccacatattctattcaattatatcagctgtcttaagccctgagctcaattcccagcccgccaagtccgttgagtatcttattcatcacagatgtgacttccttttcctccagggtgtggtccttggcccggaaggtaatggaataagccaccgacttgtggcctgccagcacctgggctccctcgtacacatcaaagagcttgtagctttccaggacctttcctcccctctgctcaatcacatcctcaatctgtcccaccaggatatcctttggcaccaccatgctgatgtccctggtcacagccgggaacctggctataccggtatacttgcggtcaaaggtggtgaaatccatgatggacggcatatcaatcacggcaatgtaagccctgtcgccaatcttatagttatcagccacatccgggtgcacctcgcccaggaagcctaccacagtgccgtcatacaggatgtcggcctttcttccgggatgaaggtagggatgctctgcgctgggatcataatggggctttttatgcattccggccttttcaaagaattcttccaccacgcccttcatggtgaagaaatcgccgtccccgtacattcccagggtgaactgcatacgctcgtcaggaagctctgtgagaggcagtgacttgggacggtacacattggccagctcgtacaggcgcacgtccttgttgcggcggttatagttggttgacagggaggtcagcatgccgtttaaggaagtggtgcgcatgacgctgaaatcctctcccaggggattggaaatctccactgttttcctcagagcgctgtcctcaggaatcagcattctgtcaaataccttggggctttcaaaggaataggtcatgccctgggaaaatccgcagaactctgctatctccctggccacctcctctatctgaagcttgtaggaaagctttcctgtggtagcttcgccggaaggcagtgtggtggggatcttgtcatagccgtagaacctggccacttcctcagccaaatcagccatgcgctccaggtcctggcgccaggtaggagcaatcacctcttttgtctcagggtcatagtccagttcaatggtcttaaagtaggaaagcatggtctcctcagaaatgtccgtgcctaaaagcctgtttatcttaacagcgtcaaaggggatccgcttactggtcctcttctcaggatagaggtcgatgatgccgcccacaacctctcccgcacccagctcctcaatgagctggcacgccctgtttactgcttcctccgccgtattggggtccagccccttctcgtattttccggaagcatccgtgcgcagtcccaccttcttggcagacaggcggatattggtgccgttgaagcaggctgactcaaataccatggtctgtacattatccgtgattttggaattctctccgcccatgatgcctgcgattcccacttccttttccccgtcattgatcatgaggatggtggaatccagctttctctcctgtccgtccagggtctggaacacatccccgtccttagcgcattttaccacgatttcgcggcctgccagctggtcatagtcaaaggcgtgcatgggctgtccgtactcttccatgacatagttggtgatgtccacaatattgttgatgggacggatgccgctggctgccaaacggcgctgcatccactggggagaaggcgcaagctttatatttttaaccatcctggcacagtaacggggacacagttcgctgttctccacccgcacattcaggtagtcgtggatatcctcgccgttgcctgttggtgtgaccaccggggcatggaatgccttgccaaaggtggccgcggcctctctggctatgccaatcacactgtagcagtccacgcggttggatgtaatttcatattcaaacaccacgtcccgcagtcccatgatttccactgcgtcggatccgggcacgctgtcccccggaaggatgtagatgccgctctccggagcatccgggtacatatccctgctggctcccagttcctccacggaacacatcatgccgcaggactcaacgcctcttaacttgccctgcttaatcctgattccttcctcaggaagggcgcctccgtcgtggcctcccgccacgcggcctccgtccagcaccacaggcaccttcacgcctatggatttctccgtgatattgggggcgcctgtgacaatctgcaccggctcttccgctcccacgttgacctggcaaaccaccagtttatctgcatccggatggcccttgacctcaagaatctctccgacaacgattttttccaggttcttatccagacatgtataaccttctacctttgttcctgtaagggtcatggcatccgtgtaatcctgggccgtgacatccaaatcagggacatatgcttttatccatgataatgctgtgttcatgtgttctctctccttctatgctgtgaatgtttatcagggcgcatgatcttagaactgtttcaggaaacggatgtcgttttcatacagcagacgcatgtcgtcaatttcatacttaagcagggcaatgcgctccagtcccactccaaatgcgaatccggaatactcatccgggtcaataccgcacatctccagtacatgagggtgcaccataccgcatcccagaatctctatccagcccgaacccttgcagaaccggcagcctgaaccgccgcatttgaaacaggtcacatccacctcggcgctgggctccgtaaatgggaagtggtgggggcggaactttacctttgtctcaggcccgaacagctctctggcgaattcggccagcgttcccttcaggtccgcaaaggtgatattcctgtcaatcacaaggccctcaatctgatggaaggagggggagtgggtggcatccacctcgtcggaacggaacacgcggcccggcgcaatcatgcggatgggaagctttcccttctccatggtacgcacctgtaccggtgatgtctggctgcgcagcagaatgttttcattgatgtaaaaggtatcctgctcgtccctggccggatggcccttgggaatgttcagcttctcaaagttatacctgtcgtactccacctcaggaccttccactacctcatatcccattcccacgaaaatgcgctccacctcttccagggcaatggtattcggatggctgtggcccacattgttcttcctggccggaagggtgacgtcgatgacctctctttttaactgctcctctctggccttcttagccagggcagtcttggcttcctccagtcttccctcaataagcccccttacatcattgaccatctggcctacctttggccggtcctccggggcaacatccttcatgctctttaacaggttcgtcagttctcccttcttacccagataagatacacggatgtcattcagtctctccagcgcttcggaagattcaatctgccttaacgcctcttctttgattttctctaactgctctttcatggcttctccttttctttgtaacaagatagaatcctgcttcccaaaacccgcgttccggaaaacaaaaaagccccgtctcttcatcactgaagggacgagactgtaaactcgcggtaccaccctgcttcctgtatcaccccggaatctacacccggaatgtacagacacttgatgcacgtaacgtgtgcctgcgtcacagactaccggaatcctttcactgattggtaaaagcatccttttgcctgtacagctccggtgggaatttcaaccgtctatctgaacccgggcaggctttcagccggtggcctcccctctctgatggaaaataaacgtctactatgcaccttcatcgcttttggattatcaaatctaacctacattctagtcacattttctgaaaatgtcaagcggaaagccagaaaatcacatttgactttgaaaaaaagaaggggtagagttatattcagggaccattttgtaccggtccttccaaaatccaatacaaaagaaaggcatatccatatgattcatcgttatgaaattccctgcatggacctgcagcagattcatcagtccggccaatgtttccgcatggttcccctgccggaacatacatacccttcaggggcaaggaacggctaccggctcatcagcggcctgtgcgtcctgcgcgcatggcaggacggccctttcgtctgcctggactgtccccatgaggacctatccttctggctgtcctatctggacatgggccgggattaccaggctgtcatcgcctccattgaccgggaaaacacctacctgaaggcagccgccatgagcgggacaggcatccgcatcctgcgccaggacccctgggagatgatcattaccttcgtgatttcccagcaaaagaccattcccaacatacgtcagctggtggaagccctcagcagccgctacggcactcttctggaggatggacagaaccggggaaacggtaaggtacgggagaaagatgaggtccgggagaaagaaggtgcccggagggaaggtgctgcccgggaaagaagtctcccgccggccttctcctttcctgcccccagccagctctgtcttgcttccctggaagatttaatggagcttaaactgggctaccgggccaagtacatccacaggctctgccaggacgctgtttcaggcaggctggacctttcccgtctgtctgcccttaactatgaggaagccatggaatatctcacgggattttacggaatcggaaaaaaagtggccaactgtgtgtgccttttcggcctccaccacatagatgcgttcccggtggatacatggatcgaaaaaatcctgatggagcagtattatgacagaaaaaaataccgccgcatccccaaaaaccgtctctgcgaaacaatcgtagcggatgtgttcgggcggtacagcggctgcgccggcatcatgcagcaatatatttttcattatgagcgcagcgtcaggcagggaagggaatgagctgtgtcactccatcatccgccccattgacgggcgcaggcgtcccgccaccgtcactgccaggatgcagagtatataatccggaatcatggtgggaaggcagtataccgcaaagatggcgccccatcccactgtgtcgggagtcaccaccacaaagtgggtgatgaagtaaaagtaaaggattcccattccgtaataaatcacataacccaccgtggcgctaaacaggcaggccccgggctttgaagcgtgcatccactccactatcttacccatcacataggctgccagagcaaatcccagcagaaacccaaaggtggggcggatcagataggaggggcctccgccccgcgcaaatacagggattcccaccagcccaatcagcagataggtggacacactgaggaaggccctcctggagccaagcaaaaggcctgccagaagcacaaagaaccactgaagggtaaaattcatggtgtccgcccccaccggtatgacaatcttaataaaggcccccaccgctgtcaacgccgtaaacagcccgcataccgtcaggtcccttgcgattccatgccgctgcaccattgtacggcttcctgtgctgcttccctgtctcattcactccactccttctgtctcatcaaaatctgcctgccggacaaatcacatcatgcccagctcaaatatcttccatttttcccgcagccccgcttccctgcccaccgcaaaatctctggtgaactctccgtctccccactgaggggccttctgcagggccttgggagaccatttctgcgaaaaagagacccgtaccaccttgtactccttatatccgtaggaggccgccagctggtcgtaacgggctttctggtcctcatattcctcctgggacagggttttaaacccatggacaatgtactcctgtatataatatccgtctttaaaatcccggtcctcctgttcaaaattcagggattccagctgattttggggaaacagcctgctgcacatgtcgaactgtcccaggcccttatacttataaaaccaggcagctgtcatctgaggcatgtccgcgggcatggactcaaatttcacatgccggggaagcacctggtcctgcaccgtatattcacttaccagcttttctccgccctttgccttgttggctgcagccacaccgaacatgatggccaggcagagcagtgtcagcccgcagattttgacggcctggggggatatgttgcgtttgctcatattatgcaatcctttcatgaccttttaacagcgggcctgggacatttccctgtgttccatggagcacttgcgtattccctcggaggtattgaaaaaccgtattccataggattttatcttgtccgtatccatggtcagattcctgggacaggaggcaaaccgctcatcgttgcgttttaatataccggcggaatcgcttcctgccagttccctgaggaacagcctggccgtatcaaaggtgttgtaccggttctcacttccaaaattataaacacctccgggaagccccatggcctcctccagatggcgcaccacttcccacacataggtgattcccctgtaatcatggacaggaaactccacctcccgcctttcctttaacgcgtccgccagcttctgcaacagcccctggcccgccgctcttcccctggacggagcgtcatacatccaagtaagcctgagggccactgcatccggcaggtatgtgagcatggcttcctccgcccgtttcttgtctcttccatacacatttcccggctttccctcgctgccctcacggttgggctccatggaatgggatgtgttgtaaatctggtcggaactggtaaatatcatacggctgccggcgttcctgcatgccttggccaggttgatggttccccttacattgaccttctctgagaggaccggatttctttcacatgtacctgtgtttgaaattgccgcacagtgcaggacataatccggccggatagcctttataaaggcggaaaccgccacaaaatcctcaatatccagttccctgtgcgtcacccccactgcctcatatccgtccctgttactataatattcacaaatccgggaaccgagaaatcccccggcccctgttatcaataagcgtctgttcattctgtttttatgcctttctacagatatgataacattatagcccactaattcttacaattctttacggatttcttaatattttaacaggctcttctttaatatgtaatatcttccagggaaatcatctcatattccgtgctgtattcctcttgtgcaagacttctgtccctgtattccgcctcccctgtctgattgtcatagggatcgtttctcaaatgagccatgggcggctcaaactcatatccgaactctctggctgccggaagacggaagggctccagatttccgaagtaaaaatcccacctctccgtctccccctcccggaaggccgctcctccgaaggaacagtccgcatagcgccagccatgggatgcggtataaaactgcgcccagtcatggcagctgatttcaaggggtgttgtatagagtcctgcctgccatctggccggaatgcctgccgcacggcacagggtgataaacaaaagcgcctgtacgccgcagtctcccttcagggacgaagccgcatactgcacaatgtcagtcagggtaaaataactccgtacaaatgaatacatcacatgggtggtaatatagtcatatatccttctggccttctttaaggggtccttttcctcccccacaatgtcagacgccagttcccgtatcagaggagtaaaccggatatggggcggctgctgcgccagccaggcatccatgggctctgcaaaaccatttgctccggttctctctttggtgcgttccgggccgccgtgttccaggctgccatgggagaaatccaggtatgcttcctggttctcaaaggaaaactccaccgaatatttctgccccttcctgtgttttgtatggaagcagatggtgcgctgaaaggcatccgggcgcgcaatggtatactcctgtgcttcggcttccctttccccgattcttacgctgtggattttcacattctttacctgggcgtattcaatcggcagaggaagatagaccttgatatcttcgccgtcccgctccgctccctccagaatcccaagtgtgccgcggatacaaaacctgcatccggcgcctccccgttctttcatggacgcaatggttctgttgagaagcgcgaagttttcagccttagactggaccagttccgggtccattgcccggttctcatattctttcctggtctttaagacatttttcaggaagctgctccgaaagcgtacctctccgtccacgtaaatccagtccgctgcatcctcctcccacagggtttccagctcactgtccttaaaatcccttacattgtcccgcagtatgccaagggcctctgtccatgtataggggtactgtcccggcatccgcttaagaatctccttttcaatcataaggcgctttctcaaagcctggggaatatccttttccagcctgctgtcaatcctacgtacagccctgtcaaactcccctctccactttaacttttctatatcctccggcagcacaaccgccagagaatcaaaataactgttatccatctgaatctccccttccattttccctgctgtggcttttccctgctacggcttctttccccgccatagcctattctctatcataccctttttttgcccattgtacaataccattgcatcataccgggaatggacgcaaaaagcccggacaggctctctgtgccgtctgtccggacttatgcttttccgttctatttgaatatgcccttcttcttaggcttctcttcctccggtgatgcgacgccgttcatcgcgtcgtcaaaccgccttaaggcctctttctgcgcctggttcatacgctccggcacctgaaccaccaaagtaacatagtggtcgcccctgacactgcggctgcgcagtgagggaacaccttttccctttaagcgcaccttggtatctgtctgggtgcccggccttacatcgtactccacttcgccgtccactgtctttatgcggatagggcctcccagggctgcccgcgcaaaggatatgggtaccgtggaataaatactggtatcctggcgcttgaatatgggatgctgggaaacaactgcctccaccagcaaatcaccgcgctcacccccgcctgtgccgggctcgccgccccctgccagacgcacgcactgaccgttgtcaatgcctgccggaatggataccttaaatttcttgcgcacggttttataacctgtgccgtaacagtcaggacacttttccttgataacctgtccggtgccattacagtcaggacatgtctgcacattctgcacagtcccgaaaaaggactgctgggtatacatgattttaccctttccattacacttggaacaggtctgaggggaggtacctgccttagcgcctgtgccgtgacagctggcgcaggtttctttaaagttgatctcgatctctttatcacagccgaatacggcttcctcaaatgtaatcctaacagaagtctttatgttggcgccccgtgaaggtccgcttctggccctcccggatctgccgccgccaaaaatatcaccaaagatatcgccgaagatatcacccatatccccgccaaaatcaaagccgccgaagccgcccccaaagccgcctgccccagcgcctccctgttcaaatgcagcatggccgaactggtcgtactgctgacgtttctgagggtcgcttaacacgctgtatgcctcggaagcttctttaaacttggcctctgcctctttatcgcctgggttggcatcggggtggtatttcttggcaagtttcctgtatgcttttttcaatgcatcctcatctgcatctttgggaacgcccagaacttcatagtaatctctcttactctctgccatgttgtttacctcttaatctatctgaacgccgcaaaactgaccctgacaggcagtttcaaaagcactctttatcagccacaaagggggtagtggccggtttcccggctcctaagccccctgtttgttttatccggatttacttcccggatttattttacttccctggatttatacttccttgaaatctgcgtccacaacatcgtcgccgcctgctgcgtttccggcgccgcccatgtcaggacctgcctggcctgctgcaccggaggcctgagcctgctcataaacctttgcaaacagcttctgagcgctgttcatcagcttctctctgccggccttgatgtcctctacctgtgcgtctgtcatctcctcaaccggagcgcggttgatggcttccttcagtgcattaaggtcagcttccacttctgccttgtcgccgggagcaatcttatccccaacctcttccagggccttctcggtctggaataccatggagtccgcatcgttccttgcgtcaatggagtccttgcgcttcttgtcctgtgcctcgtactcagctgcttccttcactgccttatcaatatcatcgtctgacatattggaaccggaggtaatggtgatgtgctgctccttacctgttcccaaatcctttgcggatacgtttacaataccgttggcatcaatgtcaaaggtaacctcaatctgcggaatccctcttcttgcaggcggaattccatccaggcggaactgtcccagtgtcttgttatcccttgcaaactggcgctcgccctgtaccacatggatatccacggctgtctggttgtcggctgcagttgagaaaatctggctcttcttggtaggaatggtggtattcctctcaatcagtctggtagccacgccgcccatggtctcgatggacagggaaagaggcgttacatccagaagaaggatgtctcctgcgcctgcatcgccggccagcttgccgccctggatggcagcgccgatggcaacgcactcatccgggttcagggacttgctgggttccttgcctgtcagctgttttaccttttcctgggcagctatcatacgtgtggaaccgcctaccaacagcaccttgcctaactcagaggcagtgatgcctgcatccttaagcgcgttctgtaccgggatagcggtgcgctctaccaggtcgtgggtcagttcgtcaaatttagccctggtcaggttcatatccagatgctttggtccctctgcagttgcagtgataaagggcaggttgatattggttgtggtagctgtagacagctccttcttagccttctcagctgcttccttcagtctctggagagccatcttgtcattggacagatccacaccctcagccttcttgaactcggaaatcatccagtttgtaatcgcgttgtcaaagtcatcgccgcccagacgggtatcgccgttggtagacagaacctcaattacgccgtcgccgatttcgataatggaaacatcaaaggtaccgccgcctaagtcgtataccatgatcttctgttctttttcattgtcaagtccgtaagccagggctgctgccgtaggctcgttgatgatacgctttacatccaggcctgcaatcttgcctgcatccttggtagcctggcgctgggcatcgttaaaatatgccggaactgtgataactgcctctgtcacagtctctcccagatagctctctgcgtcagctttcagcttctgcagaatcatggcggaaatttcctgtggggtgtacttctttccgtcgatgtctaccctgtagtctgtgcccatgtggcgcttgatggaagagatggtcttatccgcgttggtaactgcctgacgctttgcaggctcgccaatcagcctctctcctgtctttgtgaatgccacaacggatggtgttgtccttacgccttccgcgttggcaataacagttggttttccgccttccataacagccacacagctgtttgtcgtacctaagtcaataccgataatcttgctcatagtcttttcctcctgattattttatgagaatttaagtaaatttccaatgtcaatttgccacttttaccatactgtgtctgaccacgctgtccctgtacatgtaacccttctgcaattcctctgccactatgttctctcccaggctttcatcatccacatgcatcactgcgttgtggaagttggggtcaaactcctggcctactgcttcaatggctttcacgccggcttcctccagtgttttccggaactgcttatatatcttctccatgccctctgcaaggggggttccctttgcatcctcaggcacggttgccaggcctctctcaaaattgtcaatgacgggaaggattctctctataatgtccttggctcccatctcatacatggcggacttttccttgtctgtccgcttgcggaaattctcaaattccgccatctgacgtttcacccggtcggtgagctcttctatcttttcatccctggggtctttcttcttcttgaaaaatccctttttttcttccttttcagcagcaggagcctgctctgtatctccctctgcgccttccggcacatcttctgccgtctctccggccccagcggcagcctctgtcttctctgcctccccggttccggcctcagaagtctgttctgttcccgattcctgctctgtctttagggcctcgtcttccttttttaacgcttcgtctttcatatcttcactcacagcttatcacctttcatcttttttaaatgctgtatccagctgattcatcagattgcgcagagtcccaagaaccttttcataatccattcgcttgggccctataataccgatggttccccgaaggcctcctcccaaatcataattggcagtgaccacactgcagtccttcatggactgcaccgggctctcgtcaccgatataaacctgaatgcctgcttcttcctctgtaccggaattgacttccgccacaaattcctgcagcacttctttatgttccagtgtatcaatgagccggctggccttgtcgccgtccgaaagctcagggtacttgaaaatgttggtggctccgctggtataaatctgcaggtcctcttcccctgccttgatggccacagccacctcgttaagtaccaggtccaccacctggctgtggatgcctgcatcgcctttaagcttgctgataacatccagattgatgtcctctatggtcagcccgttcaggctgctgttaagcaggatgttcaggttaaggagctcctcgtcgctgagattatccgcaatatcaatcatggtgttcttgatgatattgccttccaccaccacaaccaccaaaagcttatgcttctccatcttggaaagctggatgaacttaagctttgtcttgtgataactggggccgctgatcatggtcgcgtaattggtattggctgccagcacctgggccatcttctttaggaccagttccagcttatcaaccttttggaccatcatctccttgaactcggttacctcgctctccttatccagcataatctggtccacatagaaccggtaccctttgtcggaaggaatccgtcccgctgaggtatggggctgaatgatataccccatctcttccaggtctgacatctcatttcggatggtggcagagctgagcttaaggtctgaatacttggaaatggtcctggagcccacaggctctccggtttccaggtatgtcttgatgatggcctttagtatagtgaccttcctgtcgtccaggagtgcatccaatggcatctgctcaccttcctttcttttattattagcactcaacgttcgggagtgctaacatctacattccataatatattccttctggagtcatttgtcaagagataaatccaaattcttttcatattatttaaggcctcccttttcctgccggcacatcatgtgccattcccctctcagtatcaactaaatattgaaattcatcctccactttttacataaatacttcaaatttaatgctttttctctccactttttatactcttgtaacacttgcttaatcattttaacttgacaagtaacatttttgtaatataatgaaggtacaactttataagacatataaaaccataacaatatgataagattgcgaggtcgttgtatgcattactttaagaaaacccttctggccgcagccatggctgcattcagcctcacggtggctttcccggcatttgccgacgagcctgtgggaacggatgtgaccatagtggaggccggtacatcagatacgtctgaggactcgtcccaggatatccaggaaacttccgcttcccgggaatccaaaggccgcagagccgttgtagtgaatgaagaagaatacatagcccaggggccaggcgcccaaaaggaggagaaggaggaagctccggcccccaaggagacatcactcggacgctttaccattacaggatactgcggctgcgaacagtgctccggcggtcataatcttaccttttccggtacggttcccactccaaaccacactatttccgctgatttagactatttcccccttggcaccaggctggaaatcgacgggatcgtctacacggtggaggacaaaggttcttctgtaaacggtaatattctcgatattttttacggctcccatgaggaagccctggccaaaggtacatacaccgcagaggtatttttagtgcaggattgatgcacgatgtgaagaaaaaactaccaggcatatgagcctggtaattttttgcccttctccggaaaagagggcactgggacagaaattattaccaaaattaagctgtatatggataaaaatggttctatttccatttatttccttgacaacaggaaaaaaatatggtaaaaacttgtttattgctcatatattacaaaagtattacatattatttattaatgtgttaaaaatctttttctaattattacttgggcaataggaggtattacaccatgaaattaagacacttactgaccggaaccatccttaccgtcagcctgcttgcggccactgccgtcacagcctttgcagcagcgccaaaaggaaggtttgaaacagtgaacagcaccaccatcagcggttgggcttacaacagcagtacacctgatgatgcgcttaacgtacgtatatccatcaaagataagaatacaggggaagaagttttctcccagagaatgacagccggagaatacagcgatgagctttacggcagcggaaaaggcaatggctgtcatgcctttaccctcagcatggactggagctccctgcccgatggcgtatatctggtagaaggttatgtgggagacaatgatttttccaaccccagaacctacaccaacggcaaccctgatgcaaaacaggaagcccctgctgcccaggcccagaacctggttcccctgggagtgttcaagacaacagggtattgcccatgcagggcctgttccgagggatggggacgccatacctgcaccggcgcggtggccacggccggccacaccattgccgttgacccgcgggtaattccctacggttccaaggtgatgattaacggtgtggtctatacggcggaggaccgcggcggagctgtcagaggcaatcacatcgacatcttcttcaacacccatgcagagacacgccagcacggcacccagagcgcagaggtctatctggtccaatcataaagaacaacccggcaaaagcccataaaggcttttccgggttgtttttttccgttttatacttttcacgttcaaacaggctctacccctcattgcactcccgcagttccgtaccgtggtaaaaaaagtccaatatctgcttgtagccctttcctgtctttgccattccctgggcgccgttctggctcatgccgacgccatggccaaaaccgcctccatatatatggaaggaaaggcttccgtcctcccctgtcctcttctcaatggcgataaaggcgctgggaagggtggcgcttccggtcatggtgcccccgtccttcttggtgatgatcagggacgggtttcccagtgcagagcggatggcagactgtcctttgatggtcacggtgccgtcagtacctgtgactgttagctcgcccgctatgccccccggacctctgtctgtgacggtcatatcctgtatctggcccgccccgctaatctgggcggaagccacgtcggccggaagatctgtctgccagcggaacatgggataggaggtgtcataggcaatcacatcctccctcttgatataggattcaaagccatcgttgtcctccttgcccaggctctttcctccctcttttacctccacagctctcagataggggtattttccgctgtcagtgccccatacgcctgcatctgccgtgcgtccgcaggaggtggagaaataaaaggcctcaatgggtttatcctcatagaacagcatctttccgtaagtctcctttacagcctgggtggacttatcattggcagaggtattattatagacctggaaatttgtgctgtcatccacatgggcgccatactggctgtaggtatttccctggatctggcggtaggcataggtcctggcgcacacggcctgggctttcagggcttccttttcataggacggaggcatctcgctgggcaccacctttgtcaggtaatcctccaaaaacaaatcattgaccaataccagcccctccggcgttcccttgatttccaggcttccgctgtaaaccggcgtgccctggctccgctcaatggaccggatggtgattgcctccggctcatccggtgtaatgatcatacgcccatattccagataagggctgtcaggaccaaccgtaagctgcgtgcctgcctccaggcgctctcccaccatctttcccttggcattctcatattccaaatcagcgccgcttcccagcaccagatccgcggatgcgtggaacacactcttaaagccggtgtccatcagaaggacgcggatggtcttggcgtcaaattccctttctaaaagggccgcgcacagcttgccgtctgctgccacaaattcctgaaggttatagccaaccagtatgtccgacgcgttcagcaccttaaaatcaccgtataccttatatacatgaaaattaggagccagaggaatctcgccataaccttctatctcaatggcatcctctgttacggacagcaccttgccgcttaacctgtcccttttcatagtgattttgaccagcttgccgtcctccatgtgcaggtcagccagattcccggccatcccgtcctccccgccaagcttggcgctcaccgggaattcccggtaggccgtacccagatacgccttaaaatgcctgccgtcgctttcagccagccagacattctcatagaccacgtttctggacacaaggctggatgtaatcatctccccgctcctggccagaaaccgtatctcacagtccaggaacgcgtccagggcaagtccctggaatccaaagtttccagccgtggtataagcggtccagctctcagcctggtcaagattggacggggtgccgtagagcacggcctccatctcctccaccttcccctccgggtcagtctccttcagaatggaaccgtacagctgccaccagtcctcttccggaaatgcctggtcccggttgtttctggtggatccggcctgaagcttcagcttgccggacacctggccggccatgtatgcagcctccgcgtatgtaagatatccctgggctgaggccagggaagccggcgtaagctccgggtccagatagccctcgtcgtagagataatccatgtatttcacaaaccagttgtccttttcttttgcggaaaaatgggaggttccccgctccttggccctcttttcacactcttccttgtccgtaagggccagagccatggccttcattgcctgcgcccttatgattccgtccctgggcggctccagctttactattatcaccatcagcgtgaccaccaccagcaccacgccgcttacccatgcaatcatcctgttcttcatattcggtccagctcctgtaaacgaagtaaagcagcggggtaaccgctgcttttatcatgtgtaaccccagaatgccgtctcttacttattgacgcctagcaatgctaggtgggcaacctcacttaaacatctgccttccactctacggaggcctgacatccgcttaaaaatattggaatcccttttgtctaatgtaggttcaaaattggtaagagtatcgaacaccccaggaaattacagttccacttcttttatctggtgttattataccccaaagacttgggtttttcaagttgatttttctgaacatttatggaattttttcctcaatggtccttctttccacacccgcgtcagaaatccttgcaaatataaggggctccggttccggcatctgttttcccagggtgcaggaagccaggaatttctccactgccggtccaaacagttcctcatgagaggcgtaaaggactgctatggtgtctccctctctcacactgtccccatattttttctccagaaggatgcctgcgctgtaatcaatggtatcctcctttttattcctgcctgcccccagcatcacagaggccactccgattccctctgtatccatatgggtgataaagccggtctcagaagccttcacttccctgttcaggggcgccttatgaaacagacccggattttccacgtaacggccatccccgccctggttctcaaccatggatttaaggcacttaagggcgctcccgtcctctatggcgccttgggcaagcttcctgcactgttccatatcccccctgcctgccatgtaaagcatattggcagccagttccagacatacgcaggtcaaatcctctggtccgcggcccttcagggtctcaatggcttcttccatctccagggaattgccgatggcatgacccagaggtacgtccatattggtgataagggcacagcagcgccggccggccagggttccgatggaaaccatctcccgtgccaggctgatggaatcctccagggttttcataaaggcgccgcttcccgtctttacatccaggacaatgcagtcgctgccggccgccagttttttgctcatgatggaggaggcaataaggggaatactgtccacggtggccgtcacatccctcagggcataaagctttttatctgccggaaccatgttgcccgactggccgataagggccaggccgttttcattgacaatgcggaaaaattcttcccttggtatggcagtcttaaatccggggatactctccagcttatccacggtcccgccggtatgtcccaggccccgtccgctcatcttggccaccttgacgccgcaggcagccacaatgggacctgtcaccagggttgtcttatcccccacgccgccggtgctgtgtttatccgccttgattccctcaataggcgacaaatccaccatgtccccggaatgcgccatctccagggtcaggtccgttatctcccggtcatccatgcccttaaaataaatagccatcagcatggccgacatctgataatcaggaatgtctcctgccacgaatccgcgcaccatataggcaatctcctccgtcaaaagggaaccgccccgctttttcttttcgatcaggtcatacattctcatatcacgcacctcccaagtggtcaggtccaaagctctccggaagcagctgggccagggtatattccctgtattcctccgcgcttttagccaggataatgcaaaatgagtccggattgcagaactcccgcatgacctgccggcacacgccgcagggcggacagtaatcccctgcctttccgtccggacctccgcatatgacaatggcctcaaactccctctcgccctcgctcactgcctttgcaaaagcgcaccgctccgcacagataccgggactgtaggctgcattctcaatgttgttgccggtgtacaccttcccatccctgcaaagcagggctgccgatacatgaaaatgggaatacggtgcataggagcgcccgagaccgtccagggctgtctgtatcaataattctctctccaaattccccctcctccttctgcccgggccagggaccggaccttcggacactgccggcagcccggtccccggccggttgttctattaccattataatataagccagccccttaaacaagggaaacaaactgcccctgcacatagcttctcaaatcctccggagacagggtgacctgcacgcctctctgacctgcactgaccatgatggtgtcgtaaagctgagccatttcttctatataagtagggaaatgtttcttcataccgataggagaacagccgccgcggatgtagccggtgatttcaaacatatcctttacgtgaatcatctccaccttcttctcccccgcagccctggcagccttcttaaggtccagctcctcatccacaggaatgcagcacaccagatatccttttttctcacctttcagcaccagggtcttatacatcctgtcgtggtccacccccataaggtctgcggcgtggctgccggaaagatcgttttcatccacttcataggtgcctgtttcatacactatatgggctgcgtccagaagacgcatcacattggtcttaaccatatcaaacactcctttttaccggcccgttttccctgcggaccatgtttcaggaatatcatactcttttttccactgcccgtcaatcaggccgggaccggtcagccgccgggaaaacagcgcccatggacataaagcagaaaaaaacgcctccctgaagggtttaaaagaaaatggcatggagtattcacaaaataatattatacggttataatgggaaataaatacgcaaacggcaggaaaggaaatctcatatatggaaaagaatgatatcatcatcatacacggaactgattacaagaacatggccaagcgggtcctggagcaggccggtgtggcggcagacatcggtgatttgaataaaaaaattgcgttaaaacccaatctggtaactgccaaggcgccctccagcggagccaccacccacagtgagctgctggccggtgtcatagaatacctccgggaacacggctttcaaaacatcaccatcatggagggctcctgggttggagaccacacggaagacgccttccaggccgcaggataccatcaggtgtgcagccggtacggcgtccccttcgtggacctgcagcgcgatacctggaaggaatacgatgcagcaggcatgaaaatcaagctgtgcgataaggcggctgccgtggattacatgattaacatgccggtgctgaagggacactgccaaaccaccgtaacctgcgccctgaaaaacaacaagggtgtgattcccaattcagaaaaacgccgcttccacaccctggggcttcacaagcccattgcccacttaaacaccattgcccgcaatgacttcatcctggtggacaatatctgcggtgatttggattttgaggagggaggcaatcccgtggtcatgaaccgtgtgcttggctttaaagacccggtgctctgcgatgcctttgtttgcgactgcatgggttactcagtggacgacgtgccttacataaccatggccaaaaaactgggtgtgggaagcacggacacagcccatgccaacatgatctatctgaaccaggccacagaggccgacagcaaattccgcatgaccaggcgcgtacagcacctggctgcttatacggccccggaagatgcgtgcagcgcctgctacggctccctgatatatgccctggaccgcctgaacgacatgggctgtctgaggaagggcctgcctcctgtatgcatcggccagggatacaagggactggagggcgccatcggcgtgggccaatgtacctcctgctttgccaaaaccctgggcggctgtccccctaaagcagcggatatcgtagactttttgagcacccaatggaactaagcccgttcccttaaagtccccgctgcctgagccaggccatgatatgggccccatacgccttttcttttttgaggagggtaaaatggtccgcccccttgacaaacaccacctttgagtcaggaatctgttctcccatccacagagagtggcgggggcggatcatgtccctgcggcccgtcagaatcaggacaggcgcctggatacaggacagcttctccttgtccagcctgggccatctggccataaggcctaacagctggcggctcttcacagccctttccctgacgccccggggcagcggtaccttctccagaccgcgccaaagggcgtattttaattttacctccataagcgaggctgcgctcatgcctctgggcagggcatttccgctgaccgccaccacggcggacacacgccccggatagcagctggctgtctccagggccacatttgccccgtcgctgaagcccagtatcactgccctgggcacatggaggaattccatgacctgaaccacatccgcagccatatccgggatggtcagatctcctccggccgcctcctctttcataagagaggacccgtggcccctgctgtccatgagaatcaccctgtaataccggctcataagctcagacagcctggcaaatatttcgtggctttcaccattgccgtggagcatgataagaggcataccctgccccatttccttataataaagggacgcaaaacggttgtccacatatccttccttcatcggctcagactccttcctgttgaccttcaccatatcacacctccggtaaaatgtaaatacaggcacagcccggcagatagaagtcctgccgggctgtggttatacgggtctgtatgacccgctcttatcttctgttagtattggctttttccacgtgaatattctttcccttgatcttggcatgggccatggccttcagcacatcgtccgcatagcgtccgggcacatccacaaaggtatatccgtcatacatgtcaatgcttcccaccatgcgtcccggaattcctgactctccggcaactgctcccagaatatctcccggggtgattctctgggccttgccgatgttgatgaacagtcttgccatcttctcatccccttcgcccagcacgtaatccacagcagcgcggtctgttgctcccttgcggcggtttccgtaggcgctgcgctcacggcctctgccgcggctgcttccacgtccaaagctgtccagttcatccagggaacgggctgtctcaaagctgtcaatgatgtcttcgctctcgtctcccatgctcatcttgagaagggctgctgccaaatccatggaggtgtaatcctcctccattaacttcttctcaatgatgttcaccatcttggtcaggtctgtgtcatttaacacatcctgaacctggtccagaatcttctccaccttgatttccgtgatatcatttaaagacggaatggcctggggaatgattttagtcttgcagtaacgctggatatccctgagcttatagacctccttgcccataacaaggctgaatgcctttccttcccttcccgctctgccggtacggccgatacggtgcacgtagtactcgtcatcctggggaatgtcatagttgaacactgcttccacatcccctacatctatgcctctcgcagccacatccgtggccaccagaatatcggtgcggccgttccggaagctgtccatgacacggtcacgctggacctgcttcaaatctccatgaaggccttccgcaaaataacctcttccctggagctcctgcaccaggtcatccacctgacgctttgtattgcagaacacaatggaaagcttcggcgcatacatatccagcaggcggctcataacctccaccttattcttcggcttaacctcataataatactgggtcaccttcggcacggtcagttccttcttaatcacccggaccgtcaccgggtccttctggaacttcctggcaatctccgcaatggcctggggcatggtggctgagaacatcagggtctggcgctcctcaggcagctggcttaaaatagtctccatatcctccagaaatcccatgttcagcatctcatccgcttcgtccagcactacggtgaggacatggtccacctttacagtctttcttctcatatggtccatgacacggcccggggttcccacgataacctgcgttccgtcctttaaggaacggatctgctttacgatatcctggccgccgtatataggcagcaccttcacaccgtgcatgaactttgcaaaacggcgcatctcctccgccacctggatggccagctccctggtaggaagcagcacgatggcctgaagcttcttcaccttcgggtccaccttctgaagaagaggcagaccaaatgcagctgtcttgcctgttccggtctgtgcctggccaatcatgtcacggccttccatggctaccggaatggcctgagcctgaatcggtgatgcctcctcaaatcccatctctgtgatggcgcggataatccgctcgtctaattgtaactcgtcaaacttaactgtctccatataaagttaatatcctttcttcctctgccgtcccatataaaagagcctccggcaggccgccttgtgcatattccctgactccgctgccacgcatccgtctgcctgtttccagaacatttcccccggaccccgaagcaggccttccaaagcccccggccagataccgcaccggctacgcatacgtcataccatgcaccgcaatttattagtttcttcgtgaaacgaagtcctccacgcgaacaaaaaaacgaggggtaaacaggcacgtctcgggcctttcatcctctcgcttcgtacggttattaactataacagatataaaagtcagtgtcaatggaggggttatagatttttatatcaatttcagggccggttcccgtgaaaatgcccgaatgaagcatttttcacggtccctgcctgcttttttcatgaatttaccagactttcacaggattaaagcagctgttttcacacaatttctcattcaattaaggactttctgtatctgcggaagcattttcctggtgtactcatacccccgctccatacattcccccatgagttcaaaggtcagaagccctgccttggagcttaagggcggcttcagcagcagcacctcacctgtggaggcgcagtccttcagccggccgctcataatggaaaaggagtgggaagccacctccataacgctgcggtccgaaggtgcttcgtaatcccctccgatgtccactgccagcacatcccggataccggctgcctgcagaaggttgaccgggagaatatccgtaacgcctccgtccaccagaagataccgccccaacgttctgggcgcaaatatggcaggcacgctggctccggccatcatggcttcacagagatatccgttccactcccatgtcacgtggtccatctcccgtaccttatcgctgtttgtaaagcagatggtatttccgctaatcaggtccactgccggtatgactaacttaaacacagcctcgtccatatgcttcctgccggtcatctgaaaaaaatagtcctgcagcttatctccctttataagaccggacaggtttacgccctttcccgtcagcagctggggcataaatgccagcaggccgctgtaatccgggtccagatactcgcctccgtgtttctccagatgaagcactgcctgctccatccgggagacagacattccggaggcaaaaagtcctgccacgattccccctgcgctggctcctgccactgcatccgggcgcagtcccgcctccataagggccttaagcacccccacatgggctgcccccctggttccgccgcctgccagtgccaatccatatcccataataaatccctccgccctatcccgtgtcaatgccgtaccggtaataggtacatatgcactggcacagccggatatgacagagggaagccggtgaaatatagtttattcctaaaccctgaccttcactacaatcttacgcaccttgcagggagtacctgcaatacatctgggcttgtgggcgtcctcaggagccaccaccgcgcagtccccggccttcaaaagaacggcgccgccctgctccggttccttaaagaacacgatatcatccgcttcattataaggcgcttcctcttccagccctgcccgctttgtgtagccgaactgctcctggccctccaccacatactgtatatcaaaatacagatcgtgggattcatacctgcatgcatctgccggcatggtggtatactcctgcaccgaggcaaacacctcatccccgtcaatatcaacgcggcccaggggcagtgcctttaaatccgtgtttcttaagaactcatagccctttttgaatttttcctccaggtaatcatatttctggattaaaccaatacttgtggtcagcatgtcaaccttcctttccttcgccgtttccggcaaacgccgcgatttcttcgtagagggccgtggccgcctctttgtcgtagccgtacatcatcagcacatccaggacatatggggtgcaggtgattcctgtcaggcagcgggcaaactccatgcccgcaatctctcccagacacagtatcctggaacggttggaaaacggcttcttccacagctccaccttttctgtctgggtaaatatgcaatcccttttcctgtactccgtcacatggaacagttcatgggccagcagcacgtcctccactgccctgtttcccagaagcccctccagtttttcttcccgaatcagcttctgcgcccgctctgctccgtccatgaaaatggtaatggaatccggttcctgatactgggcaaaaatcacatgcccacctccccccggcacctggggcgttaaaaccttaagccccatccgggcggcgatatcccagacatctgtcttccccagaatcagctgcgcctcacttcgcccgcactctgccgcccgaaagccgtatgccagcttctgttccctggaaaacctgccttccagcgggtccctggaccaggcatagaggtaccatgctgtctcgtccagggacagcaggtgttccatcatggaacgcagggacctttcccttgacggagccgccatctgctccatcatggccctttgttcccctgccgtttccctgctgtttcccaaaaaagcccggaacagctttctgccgtcttctctcttcatggaaaaacctcctctgcacccgtccccttctattctacaactgattctttgctccgacaatcacaatatcttccgacgggtccaccatctgcatttccacatccatgagcatgagaatctgctccaactcacctgtgccgttaaagtccatgactcgggcgcccacacacagatagtagtcgggccgcagaatggcatctgccttgaaaatggccatttcttcccacattctggaaacaatactccggtaggaggatgccttggcaaggaccacttccccgtctgtcctctgcaccttgataaatcccttcttatccaggatacgaagtggctttcggcccctgctttccatattatagacatagaagttaggcgtctggcccaccaggttcagcgcttccggcccggaccttaaatcctctgccgccaggttccttgcctcctcctcgctgcactccttaagaaggtccgttgtcttgacctccgtggagcccagtgcaatggcagtgagcttggaggtctgcgggtcaatttcaatatggacctccacggatccgggcgctgccccgctctccactgctttgtccacggcctcccgcttgatgcttctgatatcatccggcgtggggttgggtaccacccgctccaccacgtcgcggaccatggccagggccacgccgatagaggaaataacctctgcattttcaggcacactgtacttaatattcatcttattggcacagaacccaatcagggatgtggcgccgccgcccacgcccaccagggatatctggtcatgctccaggcggtacttgtcagccagctccatgataataggctcgatcttctcataggccctggtaagaatctgggaagccacatcctccaccgtggtgttcaggtaatcggcaatgggctgcatggctttcctggccgaatttacactgccgtaggaaaagtccttgggtgtcaccagtcccagcacattggccgcgcagctgttggtgatggtgatgcgcttgccgctctttaagcggatggccacgtaatcctccggatctccctccttcggagaaaagaattccagccggggctccacgatttcttcctcatctgtaaatacggcgtaatccagtcccgcaatatgggcggaacgggggcccacatcgtggacgccgctcttgttcacccgaatcatgcttccgcctgcaacgcccagcacccgcacatccagggagctgatataggtcctgtgtccgcctaccacagagtaatcaatggcagggcgtccgttcttgataacgccgatattggtggtggttcctcccacctcaaaatacacgccgttggatgccctcaggtacataagggatcccataacgctggcagccgggccggaaagcatggtcagcaccggacgcttcttcatctcattgatttccatgacgccgccgtctccacgcataatcatgagaggcacctccacgccggcctttcgcacgctctcctccgtggaattggccgtgttcagcattttgggcagaatgctggcgtttatggcagctgtcctggtccgtctggtcaggccgtagagcttggtaatgtccgaggcaacggttgtctccatacccatctcgtcatgggcaatctcgaacacaaactgctccccggcaatgtcgtccaccccgtaagcgtctgacgccaccagcacctgggcgccctccgctttaagctcctcaaccgccttcctgaccgtattctcgtcctcttcactgtcgctcagataacggttctttatctttatgcttctgccggatcccaggtcgatatccttaaggcgggtctgatgctttgccagaaagccttccatgcctccgggccccatgcccagcacgcccacgcaggccacatcgccttcaatcagggcattggtggcctgggtggtgctgtgggccacgaaaataacatcctcaggggcaatatcattttcccttaagcagttctggaatgccttcaccacgccggccgccaccccgtacctgtcatcgtgagtggtcttgacagaagattttcctatgatttcatgtgtggcgttgtcaatcgctaccgcctttgtatgggttcctccaacgtcgattcccattctcaccagtctgtttcccatgtttcttctcctcccgttaaccaaacatgataaatgttataatctgcaggatgcagcagataatccagccgcacaccacgctcatctttaaaaattccttggtagatacctttgcgtagctgattccccatacaatccatgactgggtgatgcagcaggacacgttcataaccgtggtggcggcaatcatcaggggagccaggaaggccacctcaaagcccacgccctttaaaatgcccagggtagccgcaccgcagccgtaaagggtgaagggtcctctaaacattccaaggggcgccagcacacagaaaataacggtgatgaataaggtgctgtggggaatgatatttcccaatagcgcgttgaaatatggaatgcacagttcagccgccttgttgaacatgggaaccaccagcaggaagcctaccaggggagccgtgtccaccacgccgtcaaagaagtccttgttaaaggtcctgcaggcagcccggaagcttttcagctttccacaaacaaacagcgcatagaaaccgccgatcagaaagcccatgataatgggcaccttgaacacaattaaaaggaatacagggataaagggcgtcagcagggacggtgtgggagcaaaatccagtttctggcgtaccggccttctggctgcccaggaatggaccgatttttttctcatgcagaacagaatcaggataatggtaaataccagctgtacagccagtgcaatgccgccccatttcacatactgctcataggggtacaggaccttgccgtccccgtccaggaagaacgcggtgtactgtccgaagaggacagggttcaaaaacattcccgctccgatgctcagcataaaggatacaacggacagcaccttgggaattcccagggacatgaagatgggaaggatgataacgccgatagctaccactgcgccggccccgaacagggaggaaaatatggcagccgtaacgatgcacaaaaggatacaggtgacggcgggcttgtcgccgcccagctccgtggtcttgcggataagggtggctgcgatgcctgtctctaacagcacccggccgaaccatgccccaaacactacatttaccaacactgagccccagccctccgggccgctctggaacaccttggaaaatgcctgtatccatgtaatccgtatgctgtctccattggctgcgataaattcaggattagacgccagaaggttgcctgtcatgggaaggatggtccagagaatggccataatcagcattcccatcatcaggtttccgcccctggccgcgtagacggccaggccaaagaacgatgccaaaatcagtattcctatgatatattccataagttaaatctcccctctatattgctattttagctctgtgcttcagcgctcaaggctgttaagcgtttcccacacctcgtcaatgaccggaattccgtctcttgtattggtctctctggtgatgagctccagttctcccggataatacacttccccgccttccctgattggctctgaggacttgatgtcggccagaatctcatccacgatggagtccgtttcctccggcgtgttgaatcttaaggggtcaatggctatcataatctggctcagtcccacctcgtccccaaaggtgccaatcctgctgacggaattgccgtttgtcagaaccgtcgctatcaggtccagggcaatggagatgccgctgcccttccagtatcccatgggaagcaccctccatgttttctcaatctcagccgggtccgtggtcaggttgccctttgtatcatagccgccgggaaccggaagctgctgtcccttaagctttgcctcctctatctttccgtaggaaaactgggatacggcacagtcaatgacagcgtgtttcccgctgcttctggggatggacatgataaatggattgtttccgatttttctgtccctgccgccccaggcaggcatgttgggcatggtgttggaccagcagataccgatgcatcccttgtccgctgcctgccagccgtagctgccgccccgcatccagtggttattattcccaagggccaccacgcccacgccgtactcccttgccagctccacggcccggtccatggccagctttgcattgagggggccgaatcccctgtggccgttccaccgctcaatggctcccatggaggattcacaggttgcaatggcgccggaatcaatctctcccttatccagatattccaccaccctggggaagcggttcacaccgtgggaatatacgccgtccaggctgttgtttgcaaatacggtggctgcgtcctttgcatgctttcctgaaaaacctctgctctctaaaatcctctggaacttctctaataaatcctcatactttactctcatagctctctccttttatgttagctttctcttttttttgagaaagcgctttctcatgacaccattatagcattatcaagatttatgtcaatataaaagtgttcaatctcctcatttttatacaatatgcaccatattatctcatattttttgtgcattataatcccgttttttctcgtttataaaagcgttttcttatttttggaaaataaaaaggagttggaacaaattatctttgtttttaccaactccaattctaaaaaagcgctttttcgtatttcctcataccaagccctgttctgtgttatacggctgtatgccggcaggacgcctgataaacccaggcaccggcactatacgtgctgtcttacccaatctttcagaataacgcagaaccgcgcaccaccagctggggctggatggccacgcttgtggccgactcctttccttccatcctgtccctgagcagggaagcgcacattccgcccaaaagctccggcttgttgtccagggtagtcagctcaggttcgcatattctggaatccggcgaattattacagccggtaatggctatgtcctccggcacccggtatcccctttccttaaattccttcatgagtccgatggccgtgatgtcctcgccgcacaccaccccgttgacaggccggccggcggcaagaatctttctggcggcatcccttcccccttccaggctgctttcatccacaatcaccacccggtcgtttccgtcaggtacatccctcagcttcatggcttctaaaaatccctgccgttttgccctgccgctgtccgtggcaatatcaaaaacatagaacaaatccatacgcccatggtcaaacatataatccgaagccatgcggattgcctttgtgtcatccaccaggactgaataaaaattaggcagctttacctgtccgttggcaatgactacgggcgtatcctttatcttggcagtaatctcaggataatttatcagttcattgaatacagagccgatgagcacaatgccgtctgtctgtttctctgacagtatctcgaaataccggtcgcattcctgtatggacccgcctgtattgcacaccgaaacattatatcccagattactgaactcctgttcaatcacatatatcatcctggcataatgcgtcacccgcacatccactgtcaggatggcaatattcttcatggttttggagaccatgcccctggctatggcgcttggcttataatcatactttttaagaacggcctccaccctgtcccttatcttgggattcacatttcccttattgttgagcacccgcgaaaccgtggagatagaggtccctgcctcggccgcaatgtcataaatattcatcccttcacccctttttattccttcacacttctgtgcttccatcccctgcccagctcctgctttttcgtgaaagccctttctctatattgtaatggacttttccggattttgcaagataaagaatgagatgtaatacaaaacagcagccctgcacgcccctcctatacagaattccgcgtctggctgctgctttttagcgcccttaaggcctgtcccaaaactgcaggcaatttttcctaaaactgcacaacgtcctttatctcttttgcccgttccacatgttcggcataaaggaccggcccctcgccgtgataatccttctggtattcaacgcctatctttgcccggacctttacccactgctttgtcttgtaatcctctgctcccggccatttgcacataaagcccagaaacgtcatatccgcctcacagcatgtcatggccatgcggccaggcacaaactggcccttggggaatttaggagttttaagaaccatggccgtgaattccaccaccttgtccttatagcgctccggctggtccatgcagtcaatataccaaatgccgtaatcctcaggcttaatttcaatcacatccgcgccaaggtcatagggaagatcctcctccagggcagcctgttcgatttccccttccttgtcctccaggacaatctcgctttcccggctcatggcccgtatggtcctgcggtacgcggtcagcttgtcatccgcaatcccgtcgcaccggttcacgataaccagctccgatccccgcagcatggcccccagaagaggcttcatgttctgcacatagagttcaaaggtagaaccgtcaataatggtaatctgctgataaatggtccagtcatccggcagttttaattcatcctggttccacatgccgttccactccatcagcacgcgttccggctggtagataacctccagttcattgagatactggggggtcagcttctccatgtcatccacaaacaccactgccgtcttattcttcttcagctttttctcgtcatactccgtatcgccttcctcacacacaatgagaagggtctttccctctgttttaaagtaatcctgctgcatggtaaaatccagaaactgggtcttgccggcctccagaaagccattgattaaaaacaaaggcataatatcgtcttctatctcataagccatgtctgtttccccttatccaatcagcctctgccgaacacgctgttcagctcttcctctttcaggctggcgccaatcacacataccttgcctgtataatccggtctgccctggcggatttcatactgctccggcaccaaatcaaaatacagccactcaccaggattctctgtgggaagcattcccttggcccttaacacatctccaaactccctggtgttggagagacgtttcagaacatcctccagctgctcatgggtcaccggaacaatggtttccattccccagctggtaaacacctcgtctgcatgatgatggtgatgctcatgaccgcagccatcatggtgatgatgctcatggcattcctcatcatggccgtggtggtgagcatggcattcctcatcgtgatcgtggtggtgatgctcatggcattcctcgtcatggccgtggtggtgctcatggcattcctcatcatggctgtggtgatgatgctcatggcactcctcatcatggccgtggtggtgcccatggcactcctcatcgtgatcgtggtggtgatgctcatggcactcctcatcatggtcatggtgatgctcatggcattcctcatcgtgatcgtggtgatgatgctcatggcattcctcatcatggccgtggtggtgcccgcagcactcctcgccatgaccgtcatgatggcggctctcccgcacctctgccagcagatcatccagcatggtatccttcttctcaataatctccagaagctggcttcccccaagctggtccaaaggagtggtgatgatgacagcattggcattcttctcgcgaatcatgtccacatccttctgtattttagaggcatccgtaatgtccgtacggctcagtacaatggttcccgcattctctatctggttattgaagaactctccgaaattcttcatgtacattttgcattttgccgcatccacaatggttaccgcgctgtttagctccacatccatgtcggccgatacgtcaatgaccgccttcatcacatccgacagcttgcccacaccggatggttcgatgatgatacgctccggtttgtactgtgtcagcacctcagccagggatgtaccgaagtcacctaccagagagcagcagatacagcctgaattcatctcccggatttcaatgcctgaatccttcaggaaaccgccgtcaattccaatctcgccaaactcattctcaatcaggacaacctgttctccggcaatagcctcctccaggagcttcttaatgaacgtagtcttgcccgctcccaggaatccggagataatatcaatctttgtcattttattctttccctctttctcaatatccgaagccctgccagtcctgaaagcaagtgaaaccatccgccgcccggttctgacaaagctctggttgtaaagcctgtcaattgaatattgttgcacattcactggataaagtcaagacatatggccctattctattgctattctattgccgctctgtttctatttcaccgcatcatactttcattttacccatattttaactgtcccaaagggttaggtaagagtttttggaaaaaaatgcagcaaacagccaggcagaccttctcgcctgcctggctgttgtcccggtactgcgggccagtttcctcttacgtttcttcttacgtttcttcttacatatccaaatatatatctgattacatatccaaatacatatgcatcggataggaaagatactccacatcctccagcttctccaccgtaatgtaacctgccggagcatttaaaatggtggggatccggtttacaatggtggcgcaggtgtgctccacagtggccggcttctgtacaaagaaggtggtgtccggttcccctatgattttccagtcgcacaaatcgccgtcatccggtccgtataccttgccgatacactgggtctcgataaccgggccctggaaggtctcggtggtgaccacagcgctcatgccgatgcagtttccctttggtatggtcattcccatggtctctgaatacaggtccgtgggataaaaatatggcacgcacttctgggactgggacttgatggtccatcccatcttattgcacagcgcttcattggaattccatacataacagggctccagtgtctccggatgcgcaatccgggcctcaaattcctccggtgtaagccccacgccgtgagcctttgccagggccagcccgtaatcttcaacgttatagctggtggctccctcaatcctgtcaatgcggtgtacgcctcccgccacacagccaatcatgttaatccagaaaatatcctgcataccggcccccactatggtgcagccggtttccttggccagcttatccagcttgttggtaacggcagaggacgtggtccaaggatagatggcctcctcgcaggtggtcaccacattgattcctctggacacgcacttctcaaaatggggatatacgtccgtcatgaagctgaacagggtaaccacggcaatgtcggcgtcgcactcgtccaggaccgcgtctgcgtcatcccttatcaccacgcccagctttgtgcccagccctgcaaaatcacctacatccattccaaccacggccggattcacatcaattgcgcctacaatctcagctcccttttcataaagatagcgcaggatatacttggccatcttgccgcagccatactgtaccacacggattttctcgcaattcatcatgattcttaaacccctttcctgaaaataagttacgtgttattagcttctgttaatagtataaagcttatacacggtatcaggtcaagggttatttttcctgaaagataccggcacctgaaggcgcaggaacatgcctctctcctgcatatccatgggaacctccgccaccacctcgcagatatagtcgcctgtcacctgatactccttttttctgatttcctccaccagacggcccatatattccttttccttttcaaatccattgcagtaaatgcacaggtatgtgctggccggtatctccgtaatcaggctgtcattgacaaagccccggtccaccagcacaaatatctccgtggaatagtacgtcccctccatcaagtgttccctgcgcatcacggtgcctgcattgtaaaaataaatgggggagagctggttggcaatcaggtttacctttaaatccctcagtatcttttcatacacatcaatgtcgtaatcatagaaattcacccctgaatccgtcatgtacgtcagtctgcggggtatgtattccagcacaatggttccgtccggaggtgcgttctcataccattcatagctttcaagggtccgctctatggcccttctctggtacatcagctccctggatctaaactccagctcctccaggttccggtgcaggattgtcttaaacatatcaagctcaaaatgggtcagctgctccctgatatcctttaaggacatgcccagggccttcatatgctgaatcatatccagctgggcgctctggcggatatcatagtaacggtagccattttccgcatcccggtacatgggtgaaaacaggcctgccttgtcatacagtctcagcgtctgctctgacagcccgttaagccgggccatctgtcctattgacagttctttcacagtgtgcgcctcctttttattatgtataacttccaattaaagcgtgtttttcaggattcacatagcataattatactaaaaaaaccttataccggcaataatgtttccgataccttatcgaaaattcgtcttacatttaacagttaaactctccctctccccacctctggccctcttcagcagttacagacaccacagaacgaaaacagccggagaaacagcagcctgtcaacacaggcagccatttctccggccctattatccgttggactcatcatccttcttatacatttttcgtcagatgctttacaatcttctccgcatcctcctgttttccaatcaccatcaggtggttatcccctgctatgatatggtcggcaccgggcataaacctcatgtgtccgtccgggtttttcaccgcgataaccgatatgccgtacagccgccggatatcagaatcctttatgctctttcccacccactggggaaggggcttgatttcatagatggaaatgccgtctgccagctccgtatagtcaaacacattgttggcgctgtaacgcaccgctaccttctctgccacgtcccggtccggataaaccacctcgtccgccccgttctttagcagcagcctggcgtgaatattgcggttcgccttgctgacaacgtactttgcccctatctccttaatcagactggtaacctctagactgttctggaaattatttccgatacagataaaacagatatcgaagttgccgattcccaggctcttaagcacggcctcattggtacagtctccaatcttggcgctgaccacataaggaaggacgggctccagcttctcctctgatatgtccactgccatgatttgattgtcatgcttggccaggttttcacacagatgctggccaaaccttccgattccgataacaagaattgatttcatctctaatacccctctctatcctatggtaatccgctctgccggcagctgcacatggggcttgcggttggacctggtgaatgccagggcaaaggacaagcttccgattcgtccgcagtacataagcagtataataacaatccgtgaaaatgaattcaggcttctggtaactcctgtgctcattcctgaggtgcctatagcggaacatgtctcaaagaacacatccgacataggcaggttctgggacaccataatggctatggtggctgccagcatcagacccaggttgatggtcaggatgcaggccgactgcctgatggactcgtcctccagccttctcccgaatatctccaccccgtatgtctggcggatattggaatggacgtaaagcagaagcactgccagggtgctggtcttgataccgccggccgtggagcccgggcttcctccgatgaacatgaggatggctgacaaaaacttgctcccgtctgtcagggctgccgtgtctacattgttaaatccggctgtcctgggtgtgaccgcgctgaagaaacaggccagaaaggactcagaaccattcattcccactaaaatattattgcgctccatcagataaaagagtatggtgctggtgaccaggagaactgccgttgtaaccagcacgattttggtgtgaagcatgtagtggcggaaatccagctttttcctggacaaatcatcccagacaatgaatccgatacctcccgtaataatcaggaaggatatagttcctatgaccacccagtccccctcgtaattacaaagggaactatactggctggtgtgtcccatcaggtcaaagccggcattacaaaaggcagaaacagaatgaaatattccataccaggtaccgtggaccagaccgtactccggaataaaccggcaggccagtataacagcgcctgctccctcaaaaacagctgtgccgatgataattttcttggccagcttcaccatgccgccaatctgcagggtgttgacgctttcctgcataagcccccgctccttgagtccgattttccttctcagcacaatggacaggaaaatgccgatactgataaatcccagaccgcccagctgaatcagcaccagcagcaccatctggccgaacaggctccactgggtccaggtgtccgccaccaccagcccagtcacgcaggaagcgctggttgccgtaaacaggcagttgagaaagggctcgctctgcccgtccctgctggctatgggaagcatcagaagcaggcttcctgtcatgataatcaggaaaaacccataggcaatgaactgggtctgtgatatatgtttttttaatcggtaatgttttggtttttttccaaacagcttctcattcatgttcccctcattttaaatcccacaagttatttttacggcggatccctccgcataaagagcattttagcactttagccccggactgtctactgcaaaacaggaaatagccggcggacaaaacagcaggccggaggcatcagcctctcaggcggcccagggactgccacgccatgaacaaaaggaaggcgcacaggttcaccaccaccacgctggccccggccggtatggaaaactggtaggatgccaccatacccgcgaaaaagcaggccagggacaggatgcccgaggacaccataacgcccccaaagcttttgaatacccgcatggaggaaagacaaggaaatatcacaaggctggatatgagcatggcccccatcatcctcattcccagcacaatggtcactgcggtgagaacagctataatgatattgtagcggcccacattgacccctgttgccttggcaaaattctcgtcaaaggtcactgcaaatatgcggttgtagcatattacaaacagccccagcaccaccagggacagcaccacgctgagccaaacatcctccctgctcatggccaggatgcttccgaacatataactgctcacatccgtggtcatacctgtggtcagggaggtgacgatgatgcctaacgccagggcgctggctgatatgagggcaatggccgcatcgcttttaatccggctattctccgtaatccgaagcaggaaaaaagcggccagaaccaccaccggaatggatatcttaagaggggaccagcccatggccagggcaatggagagggccccgaaggacacatgggacaatccgtccccaatcatgctgtaccgtctgagcaccaggctcacccccagcagggacgcgcacagggataccatcatgccgcccgctagagcccttaccagaaacgggtaggaaagcatttctcgtatcagattcatgatttctcctccttatgcatgtgcagcttcaccgtgtggcatccggctgtgggcttgcatctgccctgttccttctcatggaagaaatgaccggctgcctggctgttcatatagtcatgggcaggcccgtagaacaggacacgcttttgcaggtggagaatcttattggcctcctccactgcgtttctcagatcatgggacaccatgaggatggccaccttgtcctcccggttcagtctccggatcatggcgtaaaactcctggatagccgtgggatctaaccctgtgatgggctcgtccagtatcagcagggaactggtggcgcacagggccctggctatgagcacccgctgctgctgtccgccggacagttctctgtagcactgcttcctgaggggcccaatgcccagcttctccatgttcctgtccgcaatctctctttctttcctggaataaaagggaagcattccccttctgtttaagcatccgcttaaaaccacctctgagacagtggcgggaaaatccttctgggcggccgtctgctggggcaggtagccgatgccggtcctctttagctcctctgccgttacgagcgttccgcccgtaggcctgattaagcccaaaagccccttcatcagagtactcttgccggatccgttctcacccacgatgcacagataatcccccgggtccacttccatatttacatcgatcacagcatcctggttatcatatccgaaatccacatgctggcattgaattaatggtgacatattttacctcttttacattggttattccgactcagtttatcacggctcaggttattccagcccatatctcaggttctccacattctgtctcataagctggagataggtgactccctcgtcgaactgcttcctggtcacgttgtggcaggaatggagaagaaggggcactgctcctgtttcctcctggatgatttccgctgttctgtggctggaaagctccaggtaatagaccgccggaatccggtcctcctttaccttgtcaatcagataggcaatggtcctggcactgggctccgtgtccccgctgcacccggaaaaggcagcgcggtaggaaaggccgtactcatccgcgaaatagcggaaaggaaacttgtccgccaccacaatcatgtgaagacgcccctggtttaccacctgtctgaaccggctgtccaggtccttaagctccttcaggtatgcctgggtattattctcaaaacggctttcctcccgggggtctgcctctgacaaggtccggcttataatctttacaatggcctgggcattgacaggggaggtccatatatgctcatcgtattcaatgtgcatctcaaagccgtcctcatggcggtgttcttcctcctccatgccttccacatgctcttcctccaccacgtccacatagtccatcatggtcagaaccttcatgtggctggtgtccagggagcccagcactttctccacccactgctccatctcgccgccgttgcagatcagcacatcggcctcctgcatggcaatcatatcagcaggcgtaggttcaaaggaatggctgtccatacccgcggggaccaccagctttagcttcacccggtcccctgcaatctggcgcacaaaatcatagtagggaaagatggtggtcaccacaaggaggcggtcatcctttccctcctggccggcagcaggcgcctttcctgattcaggcggcctctgtccggcggcgcatccccatatacttatggccatgaccgcgaaaccaagcaaggccatgagccacataattcccctgtattttaagggctttctatcattcaattccattcacatcctttatatactgaacaacccgggacggatggtccgcaataagggcgggatggaaggacataagctcttccctggtcctaaatccccatgtcacgcccactgtatccacctttgcattgttcccggtctccatgtccgtgttggtgtctcccagatagagaatttcgctctttgaaagtcccagttcctctgctatggcccatacgccgtcaggacagggctttttcctgattccctgatcttctctctcgccgtataccaggtcaaaatatccctttccaaagacgccctccacattatccagggtcctgggatggggcttgttggacagcacggcaatgaaaatgccctgcgactttaaaaactgcagaagctccccgattccctcatatgcttccacacggtacatacagcattccctgaaaatatcctgataccgctccactgcttcctcataatgggtcagctccttatccccgcaggcaataagggaccgctccagcagcttcttataaccgtcccccacatagagccggctctcctccacgctgatttcacgcatgttccaataactcagggtatcattcacagacttctgaatggcatagattgaattcacaagggtgccgtccaggtcgaatatacagcatttatacattatagttaccattcctttccaaggatatacgtaaatccgtcttgacacaacctacatcatagcacagttcaatctgtttttccactgcatttgacaccgcacccctggcatgctatacttttttcagcacaagacagctaaattttcccacgttaaaaggagcaaaccatgacgaattcctatatgattacctgctgttccacagccgatctgccggcgtcttatctggcggagcgagacatcccctattcctgcttccatttccggatgaatggcatggaatacgatgatgacctgggaaaatccattcccattgaggatttttacgagaacatccggcagggcgccatgcccaccacatcccaggtgaacccggaacaatacgaggctatgtttgagcccatattaaaagaaggaaaggatatcatccacatgaccctctcctccggcatatccggcacctataattcggcggtcattgccagggacgagatgctggagcgctatccggaccggcggattgccgtcattgactcctgctgcgcctcagcgggctacggacttctggtggacacggcctgggagatgatgcaggcgggtgtaacatacgaggaacttgtgtcctggattgaggaaaataaaaaaagggtccaccattggttcttcacctctgatttgacccatttaagacgtggaggacgcatctctgcctcagctgccttctttggcaacatgctgaacatatgtccgctgatgaatgtaaatgtggagggcaaactgattccccgggacaagtaccggggcaagaaacgtgttatccgggaaatggtggagcggatgagggaacatgctgaacagggcgctgcctataacggaaaatgcttcctttcccaatcctcctgccccgaagatgccgaggcagtggccagcctggtggaagaaaccttccctcaattaaacggaaaggttttcatcgtggatataggcactgtcatcggttcccacaccggtccaggcaccgtatgcctggtgttctggggagacggcagaaccgtgtagagtgtgtctgaaaactgctttctgacgcgccccggccgcgctccggccctttaggttctctgttctttcatggacatcacatacagggccgcaaaaccggcagctccggctataagggccgccgccagatccgcacctgtcgggatgcctggaaaaagttcgggcagggaaccgaacatgaatcccaggataatcagataggtgggctggggatgacgggacatcagccgctccagtaccttggtggtcaggaaaatgccgcccagcacgccggctcccaggggtatcaggggaaggatatgaaaggaactgatgtttcctataatggtttcatagattcccagcatatagagcatctgagacacgctgattccgggcaggaccagccccaccgcaatgatgaatcccccagccagctgaaggagcagggccgcgggcccgaagcttccgtccggtgtaaaaagcccggagggaatcagcgccaggagcaccacccccaggatgcctatgacaggataggccaccgctcccaggtccagctttttcacgcctgcttccctgtatatcatgggaacgccccccgccaccgctcccaggaagaaaaaccggagcggaacatcggccctggttgtgagcagatagctgataaagcgcgaaaacagcaccattccggttcctgcccccagaacgaatttgaacagaaaggccatgcttcctgcaggttccttgaaaaaggagctgatggatgaaatgagcctgtcatagacccccataatcatggccatggaccctccgcttactccgggaaccgtcatggtcccccctatccacattccttttaaaatgattttcacattgtctcgattcactggaaatactccttttcaccttctgtgaccttactgcgcgcgcgtcccttccggaacaacagtaacgatattctaccccatgcagccggaaaagtgaattaattttctgtatatatttatgtccgggtacggcttattattgccccggacatgaaaataatcccggaggacaggcagttctgcctttctccgggatctatttttgaggaatatgattatgtgataatgaaacggcatatggaaccgatgtatttaattaatgtatttaaccaatacgcttaattaacgccgcactgggaatttcccggcatcatgccgactcccatctgtgacagcatggaattcaggtcctggccgcccttctggtactgtactgcctggggacaatttcccgtattgtaaagtgctgcgttgcagtcatttatatttgccatattagtgccgcatgcagaacccagcattgctgcaagtgccatagatgaaactgataacatagtatgtcctcgctttctttcttacagatattacaaatctgtttcatttctgttacaaaactatattatcacatattaggagccctgtgtctgggagttattggaaaaacaacgacttttgtctttttttgcggatttttcatgttctttggtaatatttccccaatatccctcatatattatcagtattatgtaattgacgcaaacaaaaaatacgcatgataccagcgccggttttacttaaaactgctgcctgccgtacagcggacaggcatgtcaggaacaggcatggcaatcacgattaagacaggggttgtatattatactatgttagaatatgtaaagaaaaatttttcctgcatcctttccatacaggaccacggcgaaggatgcgggtgtgcagacgaaatatacgatacggtgcagaccatgaacatcagccagaccttgaattattccatccttttaatcattatggaagccttcagcctaatcgtatatctggccacagactttacaggcagggctgtttccatgctcagctttaccatgctgctgttccttctgttcattgcccttaatattgtatactgcaaatacttattaaaacagcagcggacctgttccacaaggcggaggctgaaacaccatacatactttttcactgccatatttgccctgtactgtattacagtgaaccacatctgcctgcagagccgcctgacagcagagagtgtccttatgttttacatttacattgccgccgggcccatctattcctttaccgaagcactggcctcggtgctggctaccgccctggctgcaattccggctttcagagcccaccatgtaccgccggccctgtattccaacctgtttctatacagcttcatcagcctgttcctgtcccagatgcgctgccacatcattgtgagcaacctgcaaatggtaagaaaggccagggatgaacaggtctgtctccaggagcgggccgacaaggaccctctgacgcagcttttcaaccgcaacggctattctctccggctggaggagctgattccctacagcatacggttacatgtgccggtagctgtcatcatgatcgatattgactatttcaaacagtacaatgacacctacggccatgtgcagggcgacgaatgcctgaggaaggtggccgctgccctgtccggcagcatacaccgggaaaatgacctgatctgccggtttggaggggaggagtttcagatactgctctgtgacgtccacccctctgacgccatcaaggtgggtgaccgtttgaggaaatctgtggccgatttaaagattcccgcagccaaccggagcgcctccccctttgtgacaatcagcgtgggggtggtgagcacggtccttacctccatggatgattaccacaagctggtacgggcagcggatgatgaactttactacgccaaaagccacggaaagaatatgatttccttccgggaactgaatccggctcccagctccgacttatccctggaggacaaactggagcacgcaaagctcatatatgacagcatccccttcccctttgccatcatacaaattcaggcaaaggacggacaggcctgcgatttttcttatgtatatgtaaatgaagcctgcgcccgcctggaatgccgttccagaaacatcctctaccgcaaaagcttcctgagccattatccggacgccgatacacggcgtcttcccgcctactatgaaacagccatgcacggcggacgccagatgttttacgatttcagcccggaacgcagcaagtaccttaaaatagagtgttttcaattccacgaaggctactgcggctgcctcatcgaggatgtgacggaccagcactattttgaactgtacggcaataatgagctgggacttctgaaccaggtggtaaacggcggcatcctcctgaccagctaccaggcagatttcccggaagtcatatatatgaattccaggctgcttcacgcccttggctactgcagcctgtccgagtacaagcttttgtccgcagactccttatcgttccttaaacagctgcacccggatgacacccatacattccaggagaccatgaccgtattttccacagacgacacagtgcgcagctgcatcatacgtattcgcaggaaggacggcgcttggctgtggttcatgctcagaggcaaactgattattgacgaacacaaaaatcccctcaacctgttcactgtataccacattacccgacagctgaagcagctggggcagatggttcctcaggtggatggggattcccgtatcagtctatgaaaacacaggagctttccggcgctctaagcgccgaagatctgctccgcataatttacagatgccatggcatccctgcaataagcgtcagcgcctatggtcctggcataatcctccgtcagcacagcgccgcccaccatcacctttacggcggcggaagcagcccttagctggcggatagtttcttccatgctgggcacggtggtggtcatgagagcgctcagacccaccagggcaacctgacgctccacagcctcctttacaatgacctccggcggcacgtcccttcccaggtcgatgacctcataactgtaattttccagcaggaccttcacgatgttcttgccgatatcatggatgtcgcctttcaccgttgccaggataatggtgcctttcttttcctgtgcctgcccgctgctgtccaaggctgccttgatgacctcaaacgcagccttggcagcctccgcgctcataagaagctgaggcaggaacacagttcccttctcaaaccccttccccactcggtccagggccggtatcatctcactgttgataatatcaagcggctccctctcctttaacagtgcagtcaccgcgttgtgggcggcttccttaagccccctctcaatggctgccgccagggccgggacctggcttcctttagtctctcctgaaccggaaatgttgtctgcccctgtaccgtcccggctgccgctccttccaatggtctggcccaggcccgcgctctgtccgctgtacacgctgatatactggccgcactggggatcccggtccataagcgcgttaaagctgtagtaagcccgcatcatggcctcggagttaggatttatgatggcagctcccagtccgcattccatggccatggtaaagaatgcggcattgatgatttccctctggggcagtccgaaggatatgttggatacccccagcacggttcccactcccagctcgtcccggatgcgccgcagggtctccagggtggtaagggcccctttgctgtcggaactgaccgtcatgcagagtccgtccagaataatgtcctccggtccgattccgtactccgctgcccgttctatgattttcctgcccacggccagacgtccctctgccgtatcgggaatgccggactcatccaggcagaggcccaccgccactccgccgtattttgccatcagcggaaatacgcggctcatggactcttccttgccgttgacagagttaatcagcggttttccgttgtatatacgcatggcgcgctccatggcttccatgtccgatgtgtcgatttgaagaggcaggtcaatgatggcctgaagctctctcacagcctcctccatcatggacggctcatggatttcaggaagtcccacattcacatccagcacatctgccccgttgtcctgctggctgaccccctccttcaggatatattccaggttgtggtcccgcagggcctgcttgaatttggacttgccggtggggtttatgcgctccccaataatgattgtcttacggccggcggtcactgcctttgcataggaggacaccacagtgcggtgttttttctcgggccacaccacaggcatgtccttacaccgctgtgtcatcaggcgtatatgctccggggtggttccgcagcaccctcccaccaccacagcgcccatggccgcgatttcttccatgacaagggcaaaaccctcagcgtctatgtcgtacaccgtctttccgttctcgcttctgggaaggcctgcattggggtttaccagcacgggaagggaggacaccctcagaatttcctccaggatacccttcatctgcacaggccccagaccgcagttgatgcccagggcatccaccctcagtccctctaacagggccacggtggactccacgtttccgccggtcaaaagctttcccttttcatcaaatataacggttgcgaacacaggcaggcgttcccctgtatccggcctgaatcccgcctccctggcagccagcaccgcggccttcagctcataactgtcgctcatggtctctatgagcaccaggtctgctcccgccctggcgccaatggataccacctctttataaagcttcaccgcatcctcaaactccaggtcccccagaggttttaacaggcgtcccgtaggtcccaggtccagggccacgtatccatgtcctgcctccctgaccgcggttctggcattctccactgcggctgtcacgatgggctccagatcatccttaaatttaagcccgttggcgccaaatgtattggtggtcatgatgtctgcgccggcctccagataggaccggtgtatggatataagcacatcccggcgggtcaggttccacgtttccggaagctctcccggtttcaggccctgggcctggagcaggcttcccattccgccgtcgcagaacaggcggcgtaccttcatctcttctaatattgtcatcgtcattctccgcaagtcctcttaactgttcaaaatgtcgtttaccaggatgtccacctgctccccgctggtaatccagctggtgcagaggcggatagccgtatggctttcatccacccttccctggttggtgtaactgtacttatccttccacgactccagaagggaatccggcatgatgggaaatacctggtttgtggtgttttccaccaggaagggatatccctttttgacacaggcgcagcgtatcttgtctgccagcctgtccgcatgggctcccagctcaaaatacaggccgtcccgtaaaagctctccaaactgtatgcccagaaggcggcccttggccagcataccgcccctctgcttgatatggtagcggaaatccgccttcagctcatcgttcaatataaccacggcctccccaaaaagagcccccaccttggttcctccgatgtagaatacgtcgcaggaagctgccagggacttaaggtccaggtcattcccctccgccgccaggccgtatgccagacgggcgccgtccacaaacaggtacaggccgtacttcctgcacaccccatacaggttctccatctcagccctggtgtaaatagtgcccagctccgtggggttggagatatataccatcttcggctgcaccgtgtgctcaaagctctcgtcccggatatgggcctggtacagctcctccacctgctctgccgtaatcttgccgtcctcagagggcagggccagcaccttatgtccggtggcttctatggagcctgtctcatgtacattgatgtgggccgtcacagcccccaccgccccctgatgggaacgcagggcagatgctatgaccgtcagattggcctgggtgcctcccaccaggaaatggaccgctgcatcctcccgtccgcatagcctgcggatgatgcctgcggcctctgcgcagtaatggtcctccccgtatccgggcgtctgctccagattagtctctgccagtttcttaagtatgcgctcatgggcgccttcgctgtaatcacaattaaaacgaatcataatataattcccctttttattttatttttatgccgccgccttaaagggctttcccctgtcacctccggtaggggcagtccgtcttggcacaggcttcacagccttttacatcgcagcggtaaggtttcctgctggctcccatgaccgctgaaacagatttggagggcatcatgagaagactgtccgtcagcttgatgccgatgcgttttccggcctccagggcctctaacagcataccctggcattccagcggaaagtctccgtaaccggggctgaacctggggcgcagataacggccttttgcctcatattccgactttatcacggtacatacctggtcgcagtactcctcaatcatggccgctgccgcggcctgcatgaccacggccctgctcatctggagacggctgtacttctgaatcagatggtcggccccgcagccaagggtggccgcaaacacaataatctgatcgcagtccttcagattcccccacaagttcctgctcctggcctcaaaacagcctccgtcaattctgtaatcctcccccagtgacaaaggatattcccggtacagatgcctgggtgtggcagcttcccataattccgccatggactgctccaccatggccgccactgccccgtcagcctcctgtcccctgtaccccagatagcggaggacctccctcctgtctacgtcctgtatgtccatatgtcttttctcccgatgatcgttcttctggtattcgttctcccgacattcgttcttctggcatttgtttttctgagttttattctcccgggatatagttatgagattttttctcctgagtttttcccagtgctgtatccggccctataaaatctccgacaggttttcctttatcttcatggccacatccggcttattcatggaatacacatggataccgttgactccgttggctatcaggtcaatgatctggtccgtggcataggctattccggcctgcttcatggccgcgggattgtccccgaaccggtccacaatggacatgaacctggatggcaggtaggtccccgacatctgggtaatcctccgtatctgctttgcgttggtcacaggcatgatgccggcaatcacaggcacctggattcccttttcacggatgcggtacagatagctgtaaagaatgctgttgtcaaaaaacatctgggtggtgacaaaatcgcatccggcctccaccttctgcttcaggtaatctatgtccacagacttgttggatgattccacatgaccctccgggtaacatgcggccccgatgcagaaatcacctgcctttttgatttcccatatcagctctgaggcatagtggtattcccttggcgtactgccgtcctgggggatatccccgcgcagggccagtacattttcaatgccgcgctcctttaactcccccagcacatggtgcaccttttccctggtggatgaaacacaggtgagatgggccagaggcgtcaccccgtattcttccttgatggcggaggcgattccaaccgtataatcgctggttccccctcctgccccgtatgtaacactcataaacgagggctttaattttgcaatctccgcggctgccttctccacggaatcatatgcatcctctgtctttggggggaacacctcaaaggagagggtgggctttccttctgccagtatgtcgcgtattttcatttctgtttcccttcctcatgcgtcatccaaaaaagctccggcaccccaataatcaggattgccggagcaagcatttacatttctacggtcactttcttcagatgccagatatccttcacatactcctcaatggtacggtcagatgtgaactttccgcagttggccgtgttaaggatggctgccttagcccaccacgcctggtccctgtaagccttatccaccctctggtgcgcctcggcataggaacggaagtccttgaggataaagtaggtatcagccctgtcgctgctcttggtatttaagagagagttatagatgtccctgaacagctctgggttatccggtgcatagtagccgttaatcagctgcatgagcacacggcggatttcctggtcattgttaaagatatccatggggtaatagccgccgttgttctcgtagttaataacctcgtcggaggacatgccgaagataaatgcattgtccgctcccacttcctccacgatttccacattggctccgtccatggttcccagggtaagggccccgttgagcataaacttcatgttgctggtgccggaagcctccttgctggccgtggatatctgctcgctgacatcagccgccgcaaatatgagctctgcgttggatacgcggtaatcctcgatgaacaccaccttaatcttgccgttaatggacttgtcattgttgatgacatccgccacagcattgataagcttaatggtcagcttagcccgcttatagcctgcggctgcctttgcgccgaagataaaggtcctgggaatcatatccatatcaggattatccttcagctggttgtacagatacatcacatggagaatgttcatcagctggcgcttatactcatgaagcctcttgacctgcacgtcgaaaatggatcgcgggtccacgtcaatgccgttattctcctttatatatctggcaaggcgcagcttgttctggtacttgatgttcataaactcaaactggcacttctcatcccctgcaaagagttccagcttcttgatgtggggaaggtcggtaatccactcatcgccaattttggaggtgacccagtctgccagcagcggattgccgtgaagcaggaaccgtctctgggttattccgtttgtcttgttattgaacttctccggcatcatctcgtagaagtcttttaactcctggtgcttaaggatttccgtgtgaagcctggcaacgccgttgacggaaaagctggctgcaatcgccatgtatgccatcttcacctggccgtcgtagataatggacattttgcgcagcttctcctggttgcccggatacatggtctgaatctggttctggaacctgcggttaatttcctccacaatctggtaaattctgggcagaagccgtgagaacagctcgataggccacttctccagcgcctctgacatgatggtgtggtttgtataagcgcaggtcctggtggttacctcccacgcctcatcccatgtaagtccctcctcatccagaaggatgcgcatcaattcagggatggcaaccgtgggatgggtgtcgttcagctgaaacactactttttcatagaattttctgatgtcatcgtgcttctctttatactttttaaccgccctctgtacgctggcggaaataaagaaatactgctgtttcaggcgcagttccttgcctgcgtagtggttgtcgttggggtaaaggacctccacaatggttttggccaggttctcctgctccactgccttctggtagtctcccctgtcaaaggaatccagattaaaggtgttgatgggttctgcgtcccagatacgcagggtattcaccacattgttgccgtatccgatgaccggcaggtcatagggcaccgcgcggacagactggtatccgtcctgtacgaaatggtttactccgccctggttctcaatgcgcacatagccgccgaatttaacctcggccgcatactccggcctgcggatctcaaaggggttgccgtcctttaaccagttatcaggcacctccacctggtagccgttttcaatcttctgcttgaacatgccgtagcggtaacggatgccgcagccatatgccggatatcccagggttgccagcgaatccaggaaacaggccgccagacgtcccaggccgccgtttcccagggcagcatccggctcctggtcctctatcacattcaaatcaaagcccatctcgtccagggcttccttgatctcatccctggcgcagatattgatgatattattgcccagggcacggcccatgaggaactccatggacaggtagtatactgtcttaacgtcctttttctcatattccttgtgagtggcaatccactcgtcaatgatgacgtccttcacagcataggccactgcctggaatacctgctggggagtcgcttcatcaatggtccttcggaacatgttctttacgttgtccaccacgctgcgcttgaacgtttccttatcaaatcctttattcatcggccattatcctcctgctttaagttcctcttctatttacagaactattgtatgtaaatcattcccaaattatcagacggggcggggttttatgggccccgcctcacaatcttaccattatttcatggtcttttcaacaccgagcattacattttcgccgttaatgttccactctttgacaaagccggacatggcgccgatgctgatatggtccgccatgacctctgttttgatctcgtccgcatgggccttaatcagttctgcaatccggtcatttccatcctggaatacgctgatgtggtccatgacctcaaatccggcctccttgcgcatggtctgaatcttgcttatgagctccctcacaaagccctcctcaatcagttcaggagtcaggttggtatccagcacaacagtcacatagttgtcttcctctgtcacatagccgtccttctgggaaacatcgatcagcaggtcgtcctttgtcagcaccacttcctggccgtcatagtcaaaggtaagctgtcccttctcattcagggtgtccatggcggcgctgccgtcgatatcggtcagcgtctggcgaatccggtttaacagcttgccgtactttggtcccacggtctttaactggggcttgaaggtataggaggtaaattcccttacatcgtcggagaaaatcacctgtttcacattcagctcttcctcgataatctgcacgtagaaccttgacagctcatggtcagccttcacatacatccgggcaatgggctgacggttcttgatgttggccgcattcctggccgcgcgtcccatgacaaccaccttcagcacttcatccatgtcggattccagctccgtgtcaatccaggactcattcacctccgggaagtcgcacaggtgtacgctttcaggcgcgttcccgtccacttttctcacgatattctggtaaatctgctctgtcatgaagggaatcatgggagcagccgcctttgccacggtcacaagagccgtgtacagggtcatgaaggcattaatcttatcctgctccattccctttgcccagaagcgctcacggcttctgcgcacataccagttgcttaagtcatccacaaactcctggagggatctggccgcctcaggaatctggtaattcatcaggctgttatccactgtctttaccatggaattcatcttggacagcatccagcggtccatgaccggaagcttgtcgtattccagggtatatctggtgggatcaaaattatcaatattggcgtacagcacccagaatgcataggtattccaaagggtacccataaacttgcgctgtccctcggtcactgccttatcctggtagcgctttggaatccagggagcgctgcaggtgtagaagaaccagcggatggcgtccgcgccgtgggcggccagggtatcaaagggatccactgcattgcccttggacttgctcatcttctgtccgttctcatccagcacaagccccatgacaactacattttcataaggcgccttgttgaacagcagggtggactcagcaaggagggaatagaaccatcctctggtctggtccactgcctcggatataaactgggctgggaactgggactcgaacagctccttattctcaaagggataatggtgctgcgcaaagggcatggctcctgaatcaaaccagcagtcaatcacctcaggcacacgcttcatgggcttattgcacttggggcacttgatgtttacagcgtcaatatatgggcggtgaagctcgatttcatcggggcagttgtcggataagctctttaattcctcgatgcttccgatggaatgctggtgtccgcactcgcactcccagatattgagcggggtgccccagtaacggtttctggaaataccccagtcctgaatattctccagccagtccccgaagcggcccttgccgatggaatccggaacccagttaatggtattgttattgcggatcaggtcatccttcacagcggtcattttgatgaaccaggactctcttgcatagtaaatgagaggggttccgcagcgccagcagtggggatagctgtgctcaaagctgggggctgagaaaagcagtcctctggactccagatcctttaacaccatggggtccgcatccttcacaaaggtgcctgcaaaaggcgtatccgccgtcatatcgcccttggcgtccaccagctgcacaaagggaaggtcgtacttgcggccaacgttggcatcatcctcaccaaaggcaggtgcaatgtgtacgatgccggtaccgtctgtcagtgttacatagtcagcgcagaccacatagtaggctttcttgtgctgcttctcgcacaggggcacggagcagtcatagaggggctcatattccttgaactccaggtccttgcccttgtaagtctccagcacctcatagtcctcacccagcacggtatctgccagggcctgagcgatatagtaggtgtagccgtcgcctgtctttacttttacatagtcttccttggggttcacacacagggccaggttgctgggaagggtccacggcgtggtggtccatgccaggatataggcgtcttctcccttggccttaaagcgggcaatggcggaacgctcctttacatccttataaccctgggccacctcatgggaggacagcggggtaccgcagcgcgggcagtagggaaccaccttaaagcccttgtacaaaagacccttgtcccaaatctgcttaagagcccaccactcggactcaataaagctgttgtcataggttacatagggattgtccatatcagcccagaatccaacggtgttggagaaatcctcccacatgcccttgtacttccagacactttccttacattctttgataaacggctccagaccatactgctcaatctgctccttgccgtccagtcccagcttcttctcaacttccagctccacaggcaggccgtgggtgtcccatccggcctttctcggcaccatataccccttcatggcccggtatctgggaatcatatccttgattacacgggtctccacatggccgatatgaggcttgccgttggcagttggcggtccgtcataaaatacatagggcttgcagccctccctcatcttaatgcttttctcaaagatgtgctctgcttcccagaacttctccacttctttttcccgttccacaaacttaaggtctgtagggactttgtcatacataacgtcttcctccgttccattcatgatagatttctattctggtatgtgaaaaagattgtatatccttccatgaagcaaaaaaggcttccgtcccgaacaggacgaaagccataaaccgcttcgtttaaccacctattactgcataccatcatatgagttcccttaacgcgggaaacgcgtcccggcctattatgcgctgctgacgcatcccttcagccggacagctccggagtgattttcagttctgcattacttgcaccggtttccaccatctccggctctctgaggcgttcctgcaggcctactgtctccatctatgcctttttcatttaacttctttattataataatgcatgcgtaaaatgtcaaccgtgtatctgattttcgtttattttgacatatcagttgttccgtctctgattgttaaatttttatcatttcgtttgccttttccagaatatgtgttatactactaaccaatattactgcacagccgtcaaaatcctgccgcaccgcataccctgcgtacagcacaccggctgcgcccagggaggaacctatatggagcagagaaatcttactttactcacagacctgtatgagctaaccatgatgcaggggtatttcaaagaaaaggacgccaacgaaaccgttgtattcgacatgttttacaggaccaatccccacggcaacggctttgccatctgtgccggattgcagcaggtcattgagtacattgaggacctgcattttgatgacagcgacattgaatacctgagaagcctggatatgtttgaggaggactttctgagctatctcaacgaattccgctttacaggcaatatttacgccattccggagggaaccgtggttttccccagggaaccccttgtcaaggtcattgctcccattatgcaggcccagctcatcgagacagcgctgctcaatatcatcaatcaccagagtctcattgccaccaagacagagcgaatcgtctacgcggccaagggagacggtgtcatggaattcggactgcgcagggcccagggaccggatgccggcacctacggcgcaagggcagccatgattgccggatgcatcggcacctccaatgtgctctgcgggaaaatgttcgatgtcccggtaaagggaacccatgcccacagctggattatgagctttcccgacgagctgaccgccttccgcacctatgccaagctttatcccactgcctgcatcctgctggtggatacctatgataccttaggttccggcatccccaacgccatccaggtatttaaggagatgagggaagccggtattcctcttaccttctacggcatccgtctggacagcggtgatttggcctacctgtccaaaaaggccaaaaagatgctcaacgaggccggattcccggacgcagtgatctccgcctccaacgacctggacgagaacctgatcaactccctgaaaatgcagggagccaccatcaattcctggggagtgggcaccaacctgattacagccaaagactgcccgtccttcggaggcgtatacaaactggctgctgtaatggacaaggccacaggccagtttgtgcctaaaatcaagctgtcagaaaacgcggagaaaatcaccaacccaggcaacaagaccatacagaggatttatgataaggccaccggcaaaatcatagcagatttgatttgtctggtaggcgaggaattcgacacccgcaattccctccttctcttcgaccccttagagacatggaaaaagaccatgctggcaccagacagctataccatgcgggaactgatgatccccattttcctggacggcaggtgcgtataccagtctccgaaggtaatggatatccaggcctactgtaaaaaagagctggataccctgtgggatgagtccaagcgtctcatcaacccccacacagtccatgtggacctgtccaatgagctgtggcacacaaagaaccagctgctggattccttccacagaaaataaacagacatagacgtgcaaaaggccggaaccatctccggcctttactaatttcccatcttatcccactcagctgccaatgttcccggaaggtatttccggctcccttaaatcccgccatccaccagaaggggaagtacattctggggaaggtcgtatatgaccatatcggctttctcatccaggggcctgggtatacggtggataattaccatcttcctgccctggaagtaccgtatgtagttgctgtatacctctgaccgcagactggttcccagcaccaggagcacgtcggccctggctatctcctccgtggtacggctcatgatgctgctgtccaccatctccccgtagagagaggttccgggacgtatcatggttttgcagttcttacaatggggaacatgtctggaatccctgatctcttccatggaatacagcctgccgcagtgggggcacctgtttttgtatatgcttccgtgaaggtaaatcacattccggcagcccacctgttccggcaaatcgaaaatattggtggtaacaatacattgaagcttgttctcttcctccaacctggccagcgccctgacagacggagtcatgtcaggaatctttttcagtatctcctcgcggtaaaattcatagaaacgttccggccttctggacagacaggaaatgtgaaacagctcctccggtgattccgaatatttctgttcaatctcataagcccgtccttcctgcttaagtcccagaatgcctccctcttccatcatcccggaaccgcagatggcaaccgtatagctgctgtctgccaatacctgcttcaggagttccaatgttttttcgccaatcatacccgctcagtcctcctcttgttctgattactccagagcatgtctgatacccgcatactctgacatcattataccgcaaatccccccgccttaccacaggaatccgcgggaactgtaagcgtcagctccgtaaatcacggcgttttatgtcgaaaaaagcagtacacggctaaatcaggtcattaaagcagatggctccgtatgggcggatgctcattcggtaagcgcttccctctcctgtgcatttttcaatatagtgtatgaattcgttcaccagttcattgggcagcactgccatgataacgccggcaaagcctcctccgtggaccctgcaggcccccttctgcttttctgcaatgaacagctccgtaagcgccagggtaaccgtgattccctgctcctggtaatcgctgttggtaaagcagttctggagccatttccatgaggaattgccggatgccgttatattgtttaagaaatccttaaaacggttctccttaagggcaaggacctctgcctccacccttttattttcctcaaagaaatgcagtgcgcgcagcacggatcgatccccggcaaactgccgtacctctgccaggttgtctatcacctgttcctcggaaatctgggacaatacctcttttccaaaatacctggccacctttttcatctccgcgggaaccgaggaataatccgcgctcaggtcagcatggcccttgccggtctgtacgattatcaggctgtggtcctgggaaccaaagtcaaagtcaatcttttccaccttaggtaccagcggctccataaaatcaatggtgataaggccgcccacagcacatgccatctggtccagcaggccggacgccttgtcccagtagttgttttccgcgaacttgccgatatgggcgtatgccacggtgctcatacggccttcattaaaaaatgtgttgagcatggagcacagcagcatctcaaaggaagctgatgagctgacccctgccgcgcttatgacattgctggtgatatatgcgttgaatccgcccacacggtagccggaatccttaaatccttggagaatgccctttaccaggtccacggttcccgcctttttctcactgggttccagatggttcagatcaatggtaaaatcctggttatatgtctcgctgacaatatgtacctgattggattcattcgttccggccacccccacacaatccagattaatgctgcctgccagcaccttgccgtggttgtggtctgtatgattgccgctgatttccgttctgccgggtgaggaaaacagcttcacatccccttccccgccaaacatcttctcatacccggccagcaaatcctcatagcgctttacattggcctctaccccgtcttccccgtagagctgcgccataagagtcctggcgccgccgctctccagcagttttactgtctcgtttaccttcatgacttacctctcctatcttttctgaaacttctgaattcagtttatcacacatggcacagaaacaacaatacaatattctcctgtctttatacgtttttttaaatagggatgacaccggacatgctttgctgttataatcccgtctttgacagttagactgacagaaaaaccgctgtagcccttgaaatataggcattacagcggtttttttgtatgttttgaagtatagtaatttattcccttcccttgctttttttctggattgttttcatttggctctttgttagaaattcatagtctgtgtgaaagccacaaacattgtgaagttcatctgtaatccgttccctctcatacaaaggtacaaatccctgttcttgaatctctgcgaagttcagggctcttaaggtattcaaaatctcttcgcaggtgtatcggtagccaagccgcttttccaaaattcgataagaaagcagggcaagaaagcagataaggaaatgggccgtgatccggttctcctcctgaagataaatgggccgtgcggaaaaatccgttttcataatccggaagcactcttctatctgccaacggccttcgctcacttttaatatgccgcttacatcatcatccaacagatcggtgcagactgcatagagtccatcggattgagcttcggattcaatcttttcttcatcgaggaacttatggatgccggcagcctctccgtcctgagtcactgccatggtcccgatgaatcttgctggatcgtttgggttacggcgttccttctttgtctttccggaatcaatcatcttctgtgcgtgttcaacctgacggctgcggagcgttctctgatagcgggcatatttgggtgagtaggtgataatcaggcgctgatggagtcttttagtcgtataaggctcatctttatagtagaggcctgtgtcatcctccggaatcaggctgatatctatcggtttatcatcagaaacacgtttgaacccctgtttgttcagcgcccatgcccggtcctcggccggaagttttttaatggactgagtcacgatataagcccgttctcccatatggttgtatgcacggttatcttcagaagccaatcctgcatcgctgcagtagataaacttctggcagccaaattcgtcaagaaccttctgctccagcggctttaaggatttctgctcgttcgtgttcccggggaaaagagagaaggccaggggcatcccatccccatccatgaacaatcccatctgaatgattgggtttggccggtgttctttgctcttgccgtactttttgctgccattctcctgttcgatttctaaatagtaattcgtacagtcatagtagaggatcttgtcgttacgctcgcataggaagtggctgtttttatagacttctgattggataaagtcacactcgctgccaagaacatccagggcgcgatagacatcatggagttcgtaggatggtttctccaggaattcagaggctagttgaaaggaggcccgtttgcttacaggttccagaagccttgcgtagatcagatcggaaaggatggcattcatatcgtattggaacttatacctggccttcaatttccggcagatcttgttcatctgcaggccgtagtatatagcctgagggaacagatagccacctctgaagaaggtttgcttcttataatccagctgccggtctgcgtggaaggtgatctgaacggacttatttttaagttcttccttatacttcaaagtttccagccttgcttcttcccttgcccatgccatcacatcgtcccgggttgggccatggtctttcaggagctcagataaggttccgagtttccggatgacaacagaggtgctggtccctttgtcattgataaatcctttagttatgtaaaaagactcagaatgtttggatttagaagtagtcactctcatgggaaatccctccttacttctaattatataatatattgcaataaattacaatataataaaactaaaattttgacataaaaaatacaggttattcaatgcctgcgaggttttttctctctattcaactgtcaaactcccgagaaacaacaatacaatattctcctgtctttatacgtttttttaaatagggatgacaccggacatgctttgctgttataatctcttaaaacagtatcatgtaagaaagcaggtattcacaatggaatggaacggaaaaccctatcactccctggactatgagctgaggcagcagttcggccggaaaatctataagctgtccctggacggaggcatgagctgtcccaaccgggacggcactctgggaacagggggctgtatcttttgcagccaaggcggctccggtgattttgccgctcccagacagacggctgtatcccggcagatcgagcaggccatggctcaggtaaagagaaagatgcctgacggctcacaggattcttatatagcctatttccagtcctacaccaatacgtacgctcccctgccctatctaaagcaattgtttggggaagcagtctcccatcctgccgtcgcagccctgtccatcggcaccaggccggactgtctggagcctgaggttatcggcctgttaaaggatttaaaccgtgtgaaaccggtatgggtggagctgggcctccagaccatccatgattccaccgccgcctttatccgccgtggttacggacttcctgtgtttgaggacgccctcagacgccttaaggcagccggcctgaccgtcattgtccatgtcatattgggcctgcccggcgagaacaggctcatgatggcggaaaccgtgcaatatctggcccaaagccccatagacggaatcaagctccagcttctccacattttaaaagggaccggcctggcagattactgccgcaccaatccctttcccatgttcacaatggaggaatacattgattttgtcatagactgtgtggaaatccttccccctgaactgaccattcaccgcctgacaggggacggtccaaaatcccttctcctggcccctctgtggagcggcaacaaacggctggtattaaacaccctgcaccgccgtttcaaggagaggaacacctggcagggaaaaaggtatgtcccggattcctcctactctgccgccttttcctccaccggcgccacaattccatcctccccaaccgtcacgccataggaaatggaagtgatatactggtagaaacccgccttgtctccttcatcctccagcatcctggtatatcctccagaggatgtgcccggcaccagccgcagcagcgcgtcctccccgtcccattccacggtcagcagagctgttttcggaatgctgctgccgaacacaaaattacccaggctgtacacgatgggcctgcccttataatattccagcccctggagtacatggggatggctgcctatcacaaggtctgctcccgcgtctatatactgctgtcccagggtcctctggtactcctggggccgctcgtcacgttcaatcccccagtgcacatataccacaaggtaatcacagacttccctggcctttttgatctcctccaacagtaaggccgggtcgtaggtggtcagcatgcccggtcccttggaagtggcgttccaggaaccctccggtatgaccctggacgcgcccaggaacccgattctgcggccctttgcctccatgaataccggttttttggcttcctccagattggctccggctcccacccgcaggattccggcatcatccagggtgctgcatgtatccagcagggcatctgtaccgaaatccagggcgtgattgttggccagggtcacgatatctattcccagctcctgaaacatggatacatgttcaggcggcagccggaaggtaaactgcttatcagcagcagctgttccgcggctgctgaaggggaattcttcatttgccataaagatgtcgctgccgtcaatcacctggcggaatccgctgtccaccactccgcctatattgcctgctttccggtatgcgcccagcacatggtccgagagaaggatatcccctgcaaatacaagttttagcggagagccctcatccgatgttcctgttccggccccctgtgcttcagcgttgtctgaatgggcggataaaccgccatccgctgcgtccgggccgtctgttccttgggcgccgtccataccttgcaggccgtccgttccttgggcgccgtccgaatctgcggcggcgcctgtttctgccccgtccccttcctccggttccagtgcctccacgccagccacgccggtgcctcccgagacgcctaccatctcagccctgacatatttgtcctgtgctgagtgccatataaaatatcccgtaataccggccagcagcagccctaataataaggctgctgccacaatacatcctgttctcttcataaaacctctcctggcggacatcagactgccagtacaatccctccgtcattggcatatacagtggccacgcccgctgcgttagtaaccacaatcttcttgaatccaactctctttgccagctcatcctttacgtattcagcccgctccgggttattcacatggcagacaaccgcaatcttgccggccgcgtccaccacttcctttaccgcaatatcgcacattctctgaagggccttgttcattcccctggcctggtccagcttgatgatggttcctgtatccgcgcccataacaggcttgatgttgagggctgtggcgaaaaaagcctgcaggcccgacagacgcccgttcttgcggagtgtatccaggctctccagcacaaagtaagtattcatgccgtccctgtatgccagggttttctccaccacctcatcaaattccagtcctgaatcgcacaggttttggataaagagggcaatattcaactcccctgaggatgcggaaagcgagtcaataacagccaccttcttggcctgctccgccatacctttttccgtcatctcctcctcatacagcttctttgccactgccgccgaattatagcttccgctgaggtggctggacagagtgatgacaaacactgcttccgcttccgcctcctcaaatgctgccttaaaggtctccggtgaaggacacgctgtctttgggcactccgggcacgcctttaccatctctataaaccgtttctggtcaaatgtctcatcatccaccacctgggcactgcctacctgcagtgtcagcggtatcatctgaaatgtgggatccttcttcatatcctctgttaaatcaagacaactatccccgataatcttataggtcataattatgtcctccggtttttcttatccatgtcttttcacatgtagtattcattactacttattataacagtatggatggtaaaatgcaatgcttatatgtttccagttttatggagattttttggactgttttttgggaaggaggaccggatggggtgatagccccgttggtggaaagggacggctggggatgattggacggctgcggggcaagaaggcgtttgaccttcttaccccgcagatacccatgcctcccctgttccgcccgctcccatccataaggattaaatggggaggtgaaaaatccggctgatgctggcatgattgttaatgttattgtctgtgtgaaatttcattccggttttttatatcattccggcttctcagcgggcctgctctatggctgataaaatctggtcaatggtggcttgacggtcgccggtgtactcgatggatatttccataagtttgccgtctatctggcggaagtaggtgtcctcgtgctctgtggtgccgtcgctgttctggccggaggtctttatatacttgtattcgtaaccgcccatgtttacggtacctgtgctgtcaactgcgtaatcgtaatagcccgcataatcaatgagccattccaggtagcggtccagctgctgggtggaatcggtgtagtctatggtaagcaggtagccggttcctccgtcgtaccagtagtacatattctcgccggcctccaagggatagctgtaatagcttccgtcgcccagcatcagttctgctgcctcagggaacttcataaacaggttggcccagcggttgctgtaggtctttcccgatatggtgcctgtttcataggcctgggccggccgctggcttccttctaccatgtagccctgggcgtcaaaggtgtattggctgccgtctatggtcttggtcaggtttgtcaccatgtggccgaattcatccacatatttccatcttccgttttcttcaatccatgctttgtacatgatttggccgttgccgtccagacggtatgtaaggccgttctcgtccagggcccattcattggtgccgaaggtaccgtccccgtggagatattgccacccgcctgcctccgtatagctccagccgcctcctgcgtatggctgcatctggcttaagagcagggcggcgtttcctgcctggtcaccggaatagatctggaccagcatgtagcagtttccgccaatctccctcatgtagacatccaggaacatacggttggacagttcctccatgtaggcgtcatattcctgcttttcctcaggggtcatgtcatagcttcccatccaggcagacatatactgcgccatcagggctccgtaattaatcttaacagagtaatagccagctcctgctatgccggccgttcccatggctacataagaaccgtaggatgcatcctggcccatcatctgaagcatctcctgcatgactccctccaggctctcgccttccaggtctgccactatgccggccatggcaagatagctttcattctcctcatcaatggcagcggcaatgaaatcaatcttcaccccgtcctcttccatataggacagataatctaatcccaggttacctccataccttcccacctcaaaacctgccggaaatgtggcctcaaatccagccatgctgcttctcaccgtactgcccgcgatggtgctgagccccgtgggaagcgcccaggcagtcatggcgcctgccgcagtcagtaccgtgctaagcagcactgccgtaaaacgtttacctctcatacaacccctctccttcctactataagatatttccagtataaccgatttagaatgcccatgcaacgcaaataggaactggtttcaaaagttccctcttgcaaccagttcccatacttttgtaatgattctgttttaattccgtgtgttatacaggattactctgccttttcggattctgttttttcgccggccataatcatcataatttcattgctgcggcttacaaatgctgtcatgcgctccggagccagaggaccgtggcttaagcttgccaggtcatacagctgctcgcagattttggaggtattggcatcttccttatgacccagtacgtactgcacaagaggatggttggcgttgagcaccagagtctctcctgtacccccgaacatgcccatgtccatgccgcccatgctgtacatcttcatcatatcctgcatacgtcttgtgtcctcagatatggtaatcatggaagccacccccgcattcttcatcttctcaaccttgatgtccagcttgtcattgttcagggcttttttgaagtattccgtcagctcctcggatgttttcttaaactcctcatcgtcttcctttacctcttccttgaacgccgcgttaaggtccgtatcaatgcgcaggaacttaaggccttccttcttctgctccacatgtgagataaacgggctgtctatggcagcaggcataatgaccgcgtcaatgccctcttccttaaacatgttgatatactggctctgttccttttcattggtcacatagaaaatggtattctcatgcttttccttgttttcatccaggcagtcctgaagggtcaggtatttgccctccaggttcttgtacaggatgaaatctcccatcttttcggcaaacttctcatccttgatatatccgaacttgatgaagggtgcaatgtcgtcccaatatttctcataattttccctgtctgtcttgcacatgccggacagcttgtccgctaccttctttgtgatgtaatcggatatcttcttcacaaatccatcattctgcaaagcgcttctggacacgttaagaggcagatccggacagtcgatgataccctttaaaagcatcaggaactccgggatcacttccttgatgttatctgcaatgaacacctggctgttgtacagcttgatggttccctccaggctgtcatactccatattgattttcgggaagtacaggatgccctttaaattaaatggataatccatgttcaggtgtatccagaacagcggctccttgtaatccctgaacaccttgcggtagaagctcttataatcttcctcgctgcactcattgggatgcttgttccacagaggattggtgtcgtttaaggccacagggcgcttgttgattttatatttttccctggaaggttcgatttccacggtttccttggtaccgtcttccttttccttttcctcggttctggcaggctcgattacggtctccaccacggtatccttatcagtcagctcgtccttctcaatggtctcatactgtggctccgctgtctcattgtccagaaagatgtccacaggcatgaatgcacagtacttctcaatcacttccctggccctgtactcgttgcagaactcggtgctgtcctcgttcagatataaggtgatggtggttcccacctcagccttatccccttcctccatctcaaagtcaatgccgccctctgattcccagtggactggtttggcatccttctggtaggacagagagtcaatggataccttgtcggaaaccataaacgcggaatagaagccaagtccgaaatgaccgataatctggtcctcattggctttgtccttgtacttctccatgaaatcctggacgccggaaaatgcaatctggttaatatacttgtcaatctcgtcctcggtcatgccaagtccattgtctgtgatctttatggtcttgtcatttggattcacggacacctggattttgtactccaaatcctccggtctctcgtactcgcccatgagctccagtttcttaagcttggtaatggcatcgctgccattgcttatcagctccctgtagaaaatgtcatggtcagagtacagccatttcttgattactgggaaaatgttctcgcttgtaattgataaactgcctttctttgccatcttttatccgcctctttcttatataataatagttcatcatgttttgcaatgtttactcacaaaatacattttagtacgagacgaataaaatgtcaataaaaattagcactcatttttgtcgagtgctaataatccggtttttgaatggaaggattcatggcggtccgaagctctttctcaactatcatgcttgataatattttccgggaatcggtgtaagctgaacaggtatctgttttttcggccgggcttccagcaaaaacggcacaatcccatcctccggcagacggttgcccggcaggatcgtctgcttgtggaatttaaaggtgacgcaccacgcgtctgcgccgtcagccagagaatcccccagcggaaagcagaattcgctctgatcgtcccgcaggatgtggatgaactcctgacagtcggcgggtacggcgccgcttaccttcatctcactgattttctccgccgtgctcctcagccattccacatcgtaaatatgggggctgtccagggcaaatacaaaaaccgcaggaagatattctcctgtgccggggagccaaaggtcgctgttggcctgtaccaccgcaccgtagatcatgggggcattggcatacttctcccgccacttctccctgccaaagaagggcgcctttccggccacatcccgaaagaagcagctttccgtactgcggggtgtggagcggtaaggcgtcagcttgttcaaatccgtagggacggcggcggctttttgccggtccccaaaggcggccttgtccgcctcctcctgcgcgtccatctccgcctgcctgcctcggacagaggacatatcatacccttttttctccatctcagcaatttcttcctcagtcatagcagcatcccagccgcctgcctcttttaccgggtcaaatccaaacagtcccatgatcattctccttttctatcattgattttacatcagtacccacagcaccgcgctgcacaggataatgacagctccgctgattccctgcaggatgcgataccctttttctccaaagttccgatagacaaaagcgcgaaagcccagcccatcttccccctggggatcgcagacccatttccagcgaaagatcgcccccaacaggaacagcaaccccgccataaaaagaaagagctgccagttcgtttccagaaacggcataatccattccataaatctagtgtataagccgctcatgtgtttctcctttccatccggcttatataaaaaaccatatgaaaatcagcctgataaacggttctgtaatttttatctctattatcctttcaaatcccgctgcaccggtacctgaccggtcgatgcgtacatttaattactttttattttcaattagtaattaagtgaattatacatgaaagccgcaaaaaaagcaagacctgcgcatagaaaaacagcgcaccgcttaaatggtgcgctgtttgttgtcatttgtccgcatcggccagagaggccagataacgggataaggcggttgcctgggcacgggccgtttgctccagctcctccggaaagaagaaaggaagagaccgggccgccgagttatagatcagtaccactgagaggatcaggttgcccagctctttgggactgcatttttcctggggaatctgccagagggccagtacctgttcataaaaccgcgcctgtccctgctggtaaacctcaaactctaccgggcttaaatgtttataaacccacatttcttcctcctgggtcatcacaaagaaatggtgctgacggctgtggaccaccatatccaaaaaatgatagatagtctcctccagactcatccccttatttcccgcagtgttccgtacttcccggagcaaaagtgaaatttcatagtcgatgatatggatgaccagctctgccagggaagtgtaataattgccgtaaaagaatggcttggagatgcctacagcctggagtatgtcctggagagtggttcccttcagcccccgctgggacagcatttccagacccaccgtcagcaaatcccgccccacctgttccctctctaccttagtatagcccttctttgacatagcttcaccgcctttttgttgagataccaacagtttaccacagcagcggggaaatgtcatgcatccttggagaaatgcctggaaaagcctggaaaaatccgaaaaaaccatgaaaatacagggcgtttccgggacgcggctcatcgtctccaatggcggcgtaattcaccaaaggatgttactttttactcctgtaataagacgtaaaagtcagtgaatcaccataggtacaacagcatatcctgcatttacctgtcctctgttatagagaacataggcaactccggcaaaggttaagattataaatattatacttagtgccaaagctatttttttcattgtcctctccttattgcgctctctttcttgcagtctcttccgaaaagaaaactgccttcgtcaaattaccaaagatttcagcatcctttaattgatgaccattaccattaaagaaaacctccgtattgtttgcggatatttttatttcagtaccatcttccaaaacataggtgattattataagcggctcatatgtatccgatgccgtggaaaaaggaacataatttaaaaaatttattagtttaacagccagctctttattttcttcatcaacaaactcttttttaactccggattctgtatctgtcattgtcacctctttgatatcttccatcctgggaggacgcataagaggccagccttttgtaaagacatataccattgaaacaactgttactgacaatactacagtcactaaagttcttaaccatgtgacttttttcatctgtaacctccttaattccttcggttcttccataaatattctattaacccgatagtgaacaggactgcaaaaaggatcacgccacccagcaatgaaactcgatacggattaccggataccaacccgtaaataatacaaatcaaatcaaagccaaccgtaattaccagtgcttttaaaaatgcaagttgtgcgtatcgtttcatagaattcccctcccatggtatgtgcagtttaatcttccatccattcgtattaccaaacatctatcgctcaatcatatactgcaattttatcataaagaggcggacttatatatgtatctttccttaatttttacggaattaaaaagtatcttatatcataacaaacgttttatttcccctctcttcctttctcccaaagatacaccatcacatgttcgcctttcgtgtcatattcgccgttaaagcagaagccaatctgttcataaaggcggattgcccttgtattattttcatacacactgagatataccatgctgtctgaatattcggcatggagtctgtcaagcaaggcaagcacggcctgcctcccatatccttttccctgatatctcttgtcaatcagcagccgatccagccataaccgtcccggaaaaggggaaggaaaatagccgtacatcgcaaagccaaccagcgtgtctccatcataaatacaaacaggccgccatagctttaagttgtctgcttcttgtaagcattcgcctacactttcgataaatccggactgttcagaaaagactgacagattttcggcttcccttcggttctcactatttaccggttcaaaatgtaattgattattatttttcagattcatattaatttacctttcgttttaatgtaatataaagcagctgatttgttataagctgttagtgttccctgttttcataaagaaaaaaagaaaattcctccagcctgtgattaaccttcaattttacccttttcgtgccccgccgaaacatgttcatgtattcgtaaaatccatagttacagcttgtgtcagtaaacacataaaaatgctgtatattctctctttccatatatatacaaaaacgactgaacaattcccttccaatcccctgtccgtgataatccggatgaattgcgaaaaaagacagttctcccctgtactcctgtggttgacctgatagaagtgctgcgtatatccgatctatttcttctaaaaaccgccatgacctgcgcccctctgctgtcatcgaaaggacaagtaccgaccatccggcctgcagacgaagcactaacggacagcggtgcctgcggatatggttccccataattatcccgatgggttttccatctgccagcgcaacctgggtaaaggtttgttcagttaagcataaccgaagataggcttcggacagcctgacggcagttttgggactgtaatacgactcatgcttccatatgatattgataattgatgaaaccgccttaaagtcctgccgcttatatggccggtaaataacagcgttcatatgttttcctccaaaaataaaaagagctgaacaaaacagtgaacccgccaactgccttttcgatgaaactgtacgcagaaacatcagcagcaggcctgtccaacctattttactcagctcatgcaggtacgcctgcatcgctataataagtaactatatcaaaataaacctaaaatgtcaaaggcaggatttatgcagcggccattatggatttctgcgccactattatggatttctgcgtccgccattacagacgcctatactgtgaacacattttctgcatcctatctggacgctgcgacagaggctatgaatcccattccatatgaggagacacaaaaaaattcgcgctcaatccaaccatcaagagtcattccattttagaatataacgctatcatcatgtttttataattttaatactccagtcaatgtggtatatacatccatgcctttaccgattgatcttgagaatactttcctgactcaaagagacggttaatggcacacctccgaaattataccatgttccatcaatcaatatccaatccagtgcctcttttccatccggttttttcatccggcttttccatccggtttgaaataacaccactgggcccgtccggattacaaacagggcggcagtaccctgaccattggaatttcataggctgtccgtattacgatatcacaaaaaatatgttataatagttcataattgttgatgtattaattcaggaggtgcaagatgaaaaaactttatttcttactctcaaccacggcagcattgttatccatttcctttagcgcatatgccggtcaatggcagcaggaaggggagcattggaagtatttaaacaacgacggcacatattcagcccatacatggcaatggattgatggaaatggtgatggtatctcagaatcttattactttgacgataacggttttctttacttggatacaataacacctgatgggtattccgtaaatcaggatggtgcatgggttgttaatggcgtggtccagacaaagtccgaaacatccggcgaaggtgaatacatatctctggaggttggctataatgcaaaaattccggtgggaatggaacgagtacataacaatattctggattactacaaaagaacatctgcccgttttgaggatgcgcaaggaacccggctgattagcttcagcattgacgattatagaaaccaggccgaatatttcaggacagtagagggcacaacagatgccagttttcaggaaagaaaggctgatgcggtcggaaccacattaaaagcaactgttgttttaagagatactaaagaataccgttctggcacatggagccatgtccaattgactgattatgttggggattatcagaaacactggtcaaatgttcactactttttccagtcaaatgattttgttttaactactgtaaggatttggagtaccggagcggatatggatgttgatggttttatgaacagcctggtgaaaaatagttattatgattctgtacgataagttatcagtgttcctaaaccggccttatcatggccggataatgagtcaaggcaaaccactaatgcctgtaaatttcactgctttccggtaaggagttgttgatggtttttgtaacagatatgtcaaatcccaaaaaggcctatccagaccagtgacttccctatcataaaaaacaagtgtaagaggtaaagcacgaatagtacgctttatctctcacacttatatccccttttacggaagaaaatccctgattttcttgcttttagaaggattacgaagctttctgagagccgctgtctcaatttgccgaatgcgctccctggtcacgttgaaccgtttccccacttcctccagggtcaggggatgcccggtctccagaccaaaacgcagaatgatgacctcacgctcccgtggattcagcccctgaagcatgctgtcaatctcctcccgcaaaagaaaactctctgccttatcctctgtggaggcattggcgtcatctgccacaaaatcccccagattggagccttcctcgtcacctaccggggtctccagggatacggtatctcccgatgcctgaatcagctccgccactcttttcccggacatgtttacttcctcagccacttcctccatagacggttcacgtcccagcttcacagacaggctgcgctgggcacggcggattttatttactgcctccaccatgtggaccggaagccggatggtcctggactggtccgccagggacctggtaatggactgcttcacccaccatgtggcataggtgctgagccggtaacctttggcatagtcaaacttttccaccgctttcataagccccagattcccctcctgaaccaggtccagaaaactcatacccctgccggtatatcgtttggcaatgctgaccaccaggcgcaggttagcctccaccagcttgcggcccgcttccacatcaccttctgacttgcgtcttgcaaggtctgattcctcctccggtgtaagcagtgcaatggaaccaatctcttttaagtattcgcggattgggtctgctgtggacacgccttccaaaagccgctcctggccatatccgtcgtattcctcctcttcctcatccccgcctgaaaccatactgccgccatccagcatctcatccgggtccaggtgctctcttccccatctgaattcttccttcaccagagacggctgctccagctcggcatcatcgtctaaaagaaagtccccctccggcaattcttcttccggttcctcgggagcctgtatgtggacacccttgcgctccagcttcagatagacatcttccatctcctccggcgtcatctgaacatcccggaaatggtccagcacctgggtcatctccagacgtccttcctgggcggccgcctcaccgaccagctgctccagtctcttagacaattccattttatccatatgttatcctcccccttctcctgggacatactaaatataggtactgtattgcgtaaatccctctttataaagcggggcttacgcagcacagtaccgttattgggtcttcgggtacgttaggtacatactatctcatgggaacgcatgaacttttccactgccttatcccactcattttccaggatcttgtccatggtaaaaaggttcagtgaagttcccgtcacacaatataatgctccgtcttcgtaacggatattcagataaagtccctgtatctgctcactgcttatcccgcttccggaagcaaaagcgaatttttccgtgtccgaaggaggaagcagcaggacaatatggaagctccccggcagcttttttccttttatcagcgaaaagcatacggggcgaagcactttccaggaggaaaaggattcaatctggttcgcctccagctcttcatctgtataatatccctgtctgatgtgtccgtcgatggaaaaattgttgtaggtaacaatgttcacttccttaaccaggaagctgtcaaagtcttccttcaggaacagtttggatgtaaatgtctttacatcctctacttttaatgcaatcataaccttctcctgccctgggttataccacaggtttccaaattcttactcaattatacagtttttgactattgacgtcaaatagaaactgtggtgatttttttactgagttttttgcgggggtgcgggggtatgttctgatatgttccgatatattctgatattctctgatataatttgatatgttctgattgctttactttaacatatctctgtttattttcatagtgtcataatatcgactatatgttatttattacagcaccttcacaacctcaaagcgttcaaacgtaataggggtttgatcggtaaaagtataaccgcgcttggcagcgtcccgtgtccaatagcgtatattgcccgatttccattgttcaaagttttcgtcctcaccctcaagttttaccatatcccaagtcaggtcgcaaaacttgacggtttcaacatgcaccgtcttaatcacacaagccggagtgcttagaccgtcaagtaccagtgataaatcaccaacgcttggcgcctgctcatcctccaatataaccgaaactgttgccgttttctttccggcaagtaccagagctaaaagttcgtctgccatttcggggctatcgccaaaggaaaagcgttcaaaataatctttatctgtgtttttcattcctgttctcctattctgtaaatgtattttttcgttcgccgccttttctgttcgtatcttctgttcgtattctctgtttgccttttcgttccccttttccgccaaagacactgtttaccaataagatgctcttaaatagttgggtagtctggagattaatgattccctgttattgtctgataaaatgctgagtctgtcttgtaaatgccctgatagggctgttcaatgtaataatcatttttttctaaatagacaaacagtgtgctttttgcgccttctgtgtttatatcaatttttatatactcatcaacttgtggtatatcctgtacggattctttcgctgttgcttgtgcattgttcatagacgatatacattggcttatccactcactgtcagaatatttttccgttttttctccaaccgttatatcaattgactgtatggtgctttcctctggtaagctaatcggatttgcattttttttggaacaaccggctgcagaacatgccataataccagcaataagaaaacttaatatctttttcatcaatttacctccataaattctgtttgtcgggtgcgctttatcagcctaatatgaatatgcttgttccttccactctaatttttaatgttgaatctgtcaagtggattcatctgctcttgttatggcttgttatggctattgtgtccatgtgttgtctttatgattgtgtgttttatgattgtgtgcttgctttttgattctatgctttatgattctattttttatgatatctctctgtccgtcagctttggcggctcttgagcggctcttgagcggctcttggcggttccgtgagttcgcagtgctgccatcttgaatccgctgcgctccttcaagatggacggctggcgccgtatgcatagagacacggaaggccgggagggtaagcgagcttgccctcccggccttccgtgtctctatgcgcactgcttgtagctaggccaggtttgtataccccatcatatctcggtctacggctttggcggcttcacggccttcttgtatggcccataccaccagggactggcctctgtgcatgtcgccggctgtgaatatctggtctgcgctggtgcggtaggtgccgggttctgtggctgcgtttgtcctggcgtccaggtctatgccgaaggcgtctgccacgtaggcctgggctcctgtgaagccggcggctatgagcaccagatcggcaggaatttcacgctcgctgccttccacagctgccatgatggtgcggcctgtttcctcgtctttttggggaaccaggtttgtgattatggctttgcacaccttgccttccccgtcttttatgaattcctttacagtggtctggtactgccttgggtctgaaccgaatatgcttatggcttcctcctggccgtaatctgttttgaggattctgggccattccggccaggtgttgttctccgccctctctgcgggaggcttgggcatcatctccagctgggtgactgaaacgcagccgtgccggatggatgtgcctgcacagtcatttccagtgtctccgcctccgattatcagcacatgtttatcctttgccgatatgaaacttccgtcctccagtccggaatccagcaggctctttgtggtggctttcagaaaatccaccgcaaagtatatgcctgcactgtccctgcccggcacgtcgatatcccttgggttggaggccccgcaggccaggatgatgcggtcaaattccttcctgattttgccggcccggtaattcctgcccacatccgctcccgtcacaaaggtgattccctccttcttcatcacatccgccttgcgctcaatcacccatttttccagcttcatattgggtatgccgtacatcagcaggccgcccacacggtcattccgctcaaatactgtgacgctgtgcccccgtttgttcagctggtccgcagctgccagccccgcgggaccggatccgataaccgccaccttttttccggtgcggatggagggcggattagggagggcatatccgctgacatatgctttttcaatgatggctctctcattttcttttatggtcactgcatctccgtacagactgcaggtgcaggccgcttcgcagggtgccggacataccctggaggtgaactccgggaagctgttggtttttttaagccggttgtatgcctgtttccagttgccggtatacaccaggtcattccattcaggcaccagattgtgcagggggcatccgctgaccatccctccaatcatcatgcctgactgacagaagggcacaccgcagtccatacacctggccccctggcgtctctgttcctcctcgcttaaggaagcgtgaaactcattccagtttttaatccgatcctcaggagctttcccccttcccgcttttctctcatattctaagaatcctgttgatttacccatggttgttctgcctccttaccctcttaaattagcgtaaaatgcctcaatctgcgcctgttcgctgttcagtcccttttcctccatctgcacaatggcattcatcatgcgccggtaatcatggggaacaaccttcttgaacatgggcaggtattcactgaaatgctccaggatccgcctgcctttcagagagttggtacaggccacatgttcttcaatcaggcctttcagttccagtacatcgtatttgccggtcacttcctcgaaggataccagctccttattgaggcgcttgtaaaaactgcggtcctcatccagcacataggcgatgccgccgctcatgccggccccgaagttcttgcccgtgactccaagcaccaccacgcagccgcctgtcatatattcacagccatggtctcccacaccctccaccacagcggtggcacctgaattccggacacagaagcgctcccctgcgattccgtttatgaaagcctttccgctggtggctccatatagggccacattgccgattatgatattctcctcagcctgaaagagcacgcctttcggaggaaataccaccagcttgcctcctgaaagtcccttgccgaaatagtcattggaatcccctgccagctccagggtcagtccccttgggataaatgcgccaaagctctgtcctccgcttccgctgcagctgacggtaaatgtatcgtcagaaagcccttccgggtatttcctggttatctcggagccgaatatggtccccagggcacggttcacattggtcacctccacctgaatgcgctttttctgtccgtttccaagagcactcttaaattttctcaaaaacacctgctcatccatggtatcctccagacggaaatcaaatacctgtttcccgctgtatccggccaccttctgaccttcataagggttatccagtatccttcttaaatccacctgattggcccggccaaggggaaggttctcacgcctctttagaaggtctgtacgccccaccagatcatccacagtgcgcacacccagccttgccatgtactcgcgcagctcctgcgctatgaacagcatgaagttcaccacatactccggtttgcccctgaaacgcttcctcagctccgggttctgggtggcaatgcccataggacatgtatccaggttgcagacacgcatcatcacgcatcccagggtcactaacggcgccgtggcaaagccgaattcctccgcacccagcatacaggccattgccacgtcccttccggtcataagctttccgtctgtctccagaatcaccttgtcgcgaagtccgttcataatcagggtctgatgggcctctgccacacccagctcccacggaagtcctgcgttgtaaatggaattcctgggggcggctcctgtccctccgtcataggctgagatcaggattacctgggccccggccttggccacaccggcggccacggttcccactcctgcctcagataccagcttgacggatatcctggccctggtattggaattctttaaatcatatatgagctgggccagatcctcaatggaatagatgtcatgatggggcggaggcgatataaggcttactcccgtggtagagtgtctggtttttgccacccacggatagaccttgcctccgggcagctggccgccctctcccggctttgctccctgggccatctttatctgaatctcctgggcgcttaccaggtatcggctggtaactccaaaacgcccggaagccacctgtttgatggcagaacagcggttgttccctgccggcccgggaatcaggcggtccaggctctccccgccctctcctgtgttggatttgccgtgaatacggttcatcgctatggccaggcattcatgggcttcccgggagatggacccataggacatggcccctgtcttaaaacgcctgacaatggactccacagactccacctgttccagcgggatgcctccgtcctcaggaaacttaaaatccagcagggagcgcagatggtacatcttatcttctctgtccacctgggccgtatattgtttaaaggtatcataattacccgacctggctgcatcctgaaggagatggatggtcagcggattataaaggtgatcctcctcaccggagcgggacttgtgactgcccgcgctttccagggtcaaatccacatccagccccagtggttcaaaggcagcggagtgaaggacgtccacatcccccgcaatgtcctttaatgtaataccccccacacggctcacagtatccgtaaaatacttatccaccacatcctttgagatgccgatggcctcaaaaatctgggcgccctgataggactggatggtggaaatgcccatcttggaggcaatcttcacaatgccgtggagcacagccagatcatagtcgcagacagccgcgtaatagtccttgtccagcatgccggaatcaatcagggaacgaatggactcatgggccagataggggttgacggcacaggccccgtaccccagcagggcggcaaaatgatggacctcccttggctcgccgctttccagtatcagagccacgctggtgcgtttcttggtccttaccagatactgctgcagggctgatacagccagcagggaggggatgggtacatggttctcatcaatatcccggtctgagagtatgatgatattggcaccgtccttgtgagccctgtccgcctccaggaacaggcggtcaatggccttttccagggaggtgttcttatagtaggtaatgggaatcacctccaccttgaacccaggcttcttcatgttcttaattttaagcaaatccatctctgtcaggatgggattctccacttttaggattttgcagttttttgcggcttcctccagtatgttgccctcctcgcctacgtagacggttgtggatgtcacgatttcctcacgtatagcgtcaataggcggattggtcacctgggcaaaaagctgcttaaaatagttgaataagggctggtgcttcttggaaagcacggccagggggctgtccacacccatggcggacactgcctctgccccgtttagagccatgggaagaatcatggtcttatactgctcatatgtgtaaccgtatgttttctgaagcctcagacgttcttcatccttcatggcaggtatgcatttgtttggcaccggcaggtcctttatgctccacaggttggaatccagccactccccgtatgggttgcgggacgcatagtagtgcttaagctcatcgtcatcaataagccttccctgctttgtatccaccagcagcatttttccggggcgcaggcggtcctttttcaccaccttagtctggtcaatgtctatggctcccacctcagaagccagtatcatatagccgtcctctgttatgtagtaccgggagggacgaagcccgtttcggtccagcacagcccccaccacgtcgccgtccgtgaacaggatggaagcaggtccgtcccaaggctccatcatggtggcataataccggtagaaatccttgatttcgctgtccatgtacttgtcgttttcccagggcgcggggatggtgaccatgacggccaggggcaggtccatgccgctcataaccataaattccagggcattgtccagcatggcggaatcagagccttcctggtttatgatgggcagcaccttgtgcatgtcgtatctgaaatactcggattccatgttctcctccctggccaccatcttatccacattgccgcggatggtattgatttcaccgttgtggacaataaggcggtagggatgggcccgcatccagctgggattggtgttggtgctgaatctggaatgtacaatggcaatggctgacttataatcttcatcctggagatccgaaaaaaacagcctcagttcacccaccagaaacatacctttatagacaatggtcctgctgcttaaggataccacataggtatcttcattgctctgctcaaaaacacggcgggcaatgtaaagctttctgtcaaaatccagtcctgccttcattccggcgggcttgcccacaaaaccctgggcaatatagggcatcacgtccgtggccttcctgccgagaatttcaggcgcagtgggtacctctctccatcccaggaaggtcataccctctttgcgcacaataatctcaaacatcttcatggcctggctgcggatcagttcatcctgggggaagaaaaacatacccacgccatactctctctcgtctcctatctgaaagcccaggtgttcagtcaccttcttaaaaaatccgtgggaaatctggagcatgatacccacgccgtctcctgtcttgccctcagcgtcctttcctgccctgtgttccagattttcaacaatatgaagggcctggtccactgtgtggtggctccttatcccctttatattggccactgcgccgatgccgcagttatcatgctcaaaacgtggttcatacagtccgggctgtttctgtttggattccataggtctttcttcctttctttgtaaaaatggggggatttgataaactaatttcaaaacaaaaaaggcggcacctgtctctaggtaccgcctgcggtcattcttgtgaatttcatttaattatgtttctgcaaaaggcagattacatctcgcctaatccgctctcaatggcctcggtcagggtcttcatagcctcttcctcgtcctcgccgtcacaaatcaggttaatctcggtgccgcacttaattccggctgccattacgttcagaacgctcttagcaacaatcttcttctccccacattcaattgtgatgtcgctcttgaacttcatagcggtctgtgaaagaactcctgctggccttaagtgtaatccggatggatttacaaccgttaatgttttgctgatcataatacactctccttattcactattttgtactctggacactgccactgcccatgtcccttatgaaagattctattacatctgacttcctatgtcaagttaatcggaaaaatcctaagcaactttttcacaatcttgatgtcggaaaaaagctccggcatcattcctgaccgcgcgtgttcattcgtacgaaggaactttgcaggcgctgcacaacaggctctttaggctggatccaccttcatgataccgccttcattatggttttggatgttcctgtgacgcccgctccttttgcctttcaattgcttctgcccgggaataaacacagccgcagtaatcctgacggtaaagtccgtacaacgcggataattccacggaacgcttatagccgtttttcttcttgaaatccgaaaccagataaggaattccatactgcccggccagtctgcatccgatatcattgagccaccgggcattctttaaagggctgatggacagggtggttgtgaaataatcaaagtctcctgaaaccgctgccctggcggcgcggtcaagccgcagttcatagcagcggcagcaccgctccccaccctccggatccttctcatggcccctggcagctgaaaagaattcctccggttcatagctgcctgccaggaacctgaccggcctttccgtctccatttcccgtatcagccgttcctgctccttcaccctggcctcatactctgtctcaggaaaaatattgggattataataatacacggtcacatcaaaatattggctcagatattccagcacatagctgctgcagggagcacagcagctgtgcagcagcagcttagggacccgtccctcttcccgcagtccctctataagccggtccaattccttctggtagttgcgcttctgtcctggctgtgtcattccttttttgtcctttcctgaaccctctgttatttttacctgccaaaaagagaggccgcccgtttacggcccctcttttttaatactcccaaattttctcaccataacagcaggcccaaacccctctgggcctatgcacggtaagtcttacaggaaatccctgattcgtttgcttctcaccggattgcgcagctttctgagagccttggcctcaatctgacggatgcgttccctggttacattgaattccttgcccacttcctccaatgtacggggatgaccgtcttccaggccgaaccgcagtacaatgacctggcgctccctctccttaaggtctcccaaaagagcgtcaatgtgttcccgcagcatcacggattccacattgccctccggagtcaccacattgttatccgccacgaaatcacccagattggagtcgtcctcctcaccaatgggtgtttcaagggaagccggctccctggcaatctgcatgatttccatgaccttatcttccgtcatatcaagagcctctgccagctctgtcacagaaggctcatagcccagctccagcgtcagctttctctgcatcttggacatcttgttgatggtctctaccatatgcaccggtactcggattgtcctcgcctgatctgccaaagcccttgtaacggactggcggatccaccatgtagcatatgtacttagtttgtaaccctttgtatagtcaaacttttccacgcccttgatcagtcctaaattgccctcctgtaccaggtccaggaagctcatgcccctgcctgtatagcgctttgcaatgctgaccacaagacgcaggttggcctcgattaacctctcctttgcaaactcatcgccgtcagccttgcgctgggccaaatcaagctcttcgtctgccgtaagaaggggcacggtgccaatttctttgagatacatgcggaccgggtcctctgttccgattccctctaacaggtccactgcatccaggtcgatttcttcctcttctgcatctttaatgaagctgtcgtcgtctaaatccaggtccaaatcaatgtcatcaagcagaacagtgtcctcggtaagcatcgcttcgtccagtacggggaccacgtcaatgttgcggccctccaggtaactgtaaatttggtccatctgttccggtgacagattatccccggtaaaaaaatcattaatctcccctgcatccaatgtgttgtgtttggtttttgcatgttcgaccagcttttccagcttctttaaaaaatcgtccttttccactgataaacgtcctttcgcttaaaggtaaatgtggaaactcccacaacttatcattatataccatcgaaaaccttatttcaacaattttcgacatttattttttattctatcagtttacgccctgattcctctcccggatgattcctcaacagaatctgcacgttctccctgatatttccaatggtgacctctgtcctggatccgccatactcgccgtccagcacccagtccacctcctgttccgaagtaaggcgtatggaggatgtcttgaacttatacacatactcgttgggttcttccctgagaaacatgtaggatatgatattactcaaatccaccggtgtcctgggcatccgtataagcagcacctcaaagagaccgtcattgagagccacagactggttcaccagccccttaaacccgcctacactgatggtattggtcaccatgccaaaggcaaaatcctcctccagcacctgtccgtcccactccaccttcatatgatagggcttcagtcctgccaggctctttacgccttccagcatataggcctggtgtcccaaaagattcttcctgtcctgggatgtcagataggacacctctgtaaaagccccgaaggctgctatatacataaaattcatgtcctcgcaaaaggttccggtgtcaatggcaaagggggttccctccacaatatcccaggcagccagcggcatgcgctttggtattcccaggctggtggcaaagtcattggtggatccggcaggaatatagcccagaagcggcattttcttaagcttcatcattccggatatggtttcattgagtgtgccgtctccgccgctgcacaccaccacatccacctttttacccagcctggccaccacttccatggcatccttctgcttttgggtaacgtggacacgaagctcatatccggccttggtgaaaatatccagtatttccatcagctgtcccttgatctgttccttaccggaacggggattgaatacaaacaacatttttttcatcctgcattcctccctttcagtgtaaccatttttgtcaatcttatccaatgagctttgtatatgcgttaaatgcattgggcaaagcgtatgtgtgctccagttcctccctggataccatgaaacaggataagggctcctcctcctgtgagagaaccaccctgtacccggtcatatgccactccacatgtgaaaacacatgctttgcctccggcagcagctccacccacgccacttgttccctgtcaagtcccagcacctgcggcaccgtctccccggaagtctttccctcaatgttgggaagctcgtaaagggaggccagcagtcccttgggagggcgcttgcgtatggccaccttatcctgatattctatgataaaaacggtccgctcctcgatcttcctcgccttagccggagatttgtacggaatctccttccaccagccgttctttcttgtaaggcagatggaggccagaggacactggctgcatctgggttcgccgccgggtatgcacaccagcgcgcctatttctatgagaccctggttgtaatggctggcctcatcctgcggcatcacggctttaagctctgcctcgatgccggccttcaccgaggctttctttatatcctccctgtcccccaggagcctggaaatgacgcggagaacattgccgtccacggccggcagcggaatgccataggcaatggaggcaatagcccccgctgtatagcttccgattcccggcagccgtatcagttcatcaaaggatgcaggaaggcagccgccgtattctgacataatcatctgggccgctgcctttaaatttctggcccggttataatatcccaggccttcccacatcttcatgagatgatcgtcttctgcctgtgccagatgggacacagtgggaaacgcttccatgaagcgctcaaaatagggcttgaccgcctctaccctggtctgctggagcatgatttccgatatccataccctgtatggcttcggatcatccctccatggaagggagcgggccctggatgaataccaggccagcagggggcgttccacagcactgagacgttccctgcgtccaagaggcatctcctccctctccagtacctggaggcggtcatacaaatgtcctgtatcatacatatccatatatacctcttaccgatacctcccctgaaatgacggctgatatgtttccgtcctctcgtctgaccagaaggctgccttcattgtcaatgcccagggcctttcctttgtactggcctctggggtccagcaccaggacctctctgttcaggttgacaagggccttattgtagtcatccctgagacccgacatatcacatgtcttcatgaagatatcataataatattcaaaactgtccgccactgcggcaatgactaaactgcgcttaatgctcctgcctgcctccagcttaagggaggtggctgttgccctgatttcctccggaaagtcatctatatttacattgattccaataccgggtatcacatagcggatgcattccacttccgtactcatctccgtgaggattccgcatatctttttgccattcagcaccgcatcgttgggccatttaatcatggcctcaaatcccgtgctctccttcacgcccctgaccactgccagccccgcgataagggtcagcatggatgcgctcatgggagacatggccggcctgagcaccatgctcatccagatacctgtaccggccggggagacccagctttttcccctccgcccttttccggctgtctggcggtctgcaaccaccagtgtgccgtggggcgctccctcttctgccagtttcctggctcttatattggtggaatccgtctcatcaaaatattccagcctggtcccaatccactgcgtgtgcagcatggatgcaagctcagcctgggttatgacgtcagcaccttccacaagccggtatcccctgttccggaccgcctctattacatatccttcttccctcagttcacctacagccttccagacagcagtgcgggaaactcccagcatcccgcacagctgctgtccggacaggtaatccccggtgcttttgagcatccgcaaaatctctgtcttcatatgccgctcctctatgcccagatactgatggcgcttacgatgccaaggaccataagacctgccgccaaggccagctgcaggatgctggcaccgaactttttcttatcccttcccctggtcttaagctcaaatattccgtttaccgcatttaacaatgctgccagcaaaaacaccagagggaaaagcatatgatttccctccgggttaatgaatgacagcacagccaggattacaatggcaatcccaagtatcaggtgcaccatgtccaggaataccccggaatggcgttcactccgtcctctctgtccctgcatatattatgattctcctaacgttgcaagcataactgctttgatggtatgcatccggttctcagcctcgtcaaacacaaccgactggcctgactcgaatacttcgtctgttacctccagctcggacacattaaaacgttctcccatctccttgccaatcttggtcttaaggtcatggaaagagggcaggcagtgcaggaaaatagccttaggtccggccaggtccatgacagcctttgtcaccttgtatggagtcagctcctcaatcctctcctcccatacctcgtcaggctcacccatggatacccacacatccgtatcaatgatatccgctcccttaaccgcttccgccacatgctctgtgagagtaacggaaccgccgctggccgccgcataggcctcgcattccttgaccagagatgggtccgggaaatacttagccggagcacaggccacgaaatgcatgcccatcttagtgcaggcaatcatcagggagttacccatattataacgcgcatctcccatatacacaagctttaagcctttcaaacatcccaaatgctcccgtatggtgagaagatccgccaacatctgggtggggtggtcctcattggtcaggccgttccagacaggcacaccggcgtactttgccagttcctccacgatttcctgtccgaaaccgcggtattcgatgccctcatacattcttcccaaaactcttgctgtatccgcaatgctttccttctttccaatctgtgaccctgacgggtccagataagtggtacccatacccaggtcatgggctgccacctcaaaggcgcaacgcgtcctggtactggttttctcaaagataagggccacattctttccgcgcagcgaatctaccagaaccccctttttctttttatccttcaggtccgctgccaaatccagcagatatgtaatctcctccggtgtataatccttcagtgtcaaaaaatgtcttccttttaagtccatagcgtcctccctgttatgccgcccatgtcctgccatggccccggcttgattttctgcaataaataaccatgcatttctatttgaaaacgcatagttatttatatttatgcatctttatgcataatatactacacctgagtgctgctgtcaagtatgggaatcatggcttttaatgcagcggtaccagcttttttatgaattaggcgcagcagttcctccactgtataaattttaaaacggcttatacggtattgttttgccaaatcctccagtatggacaggtacagctccttatagtcccatccctccttcagtttcagttcctttgccagccggggaaatacctgttctgtataaacacggtatcccgcaaggaggtccttctgttcctcccgcccgtgctttgcctctcctgcctcctgcagctccggttccatgtaagaaaggaggctctgtatctccgatatcattttatcaaaatagtaaggctcgccttccggcgcatcaatataatagacacgtcccgccagaccataaagcatacgttttccgtcgaaataccccagcagcatgtttcttctcgcccggcgtctgtcaaactccagaaggccgcccaaatccctcctcggcgccacatggtacagggttgctccttccggtacctccagcttcttttccgtgtccacaccgtaaccatatatccgcaggacaatcacgtccctgtaacctctgtccagaagcacatccaccggcacattattgattccgccgccgtccatataatacttgccgcccagccgctcctgacggaagccgagcagataggcgctggccataagcaggtccgctattcctccctccggagcctccttcacatcggcaataaggggttgccggtcagaaatggagtaggttaccacatagagctccctgtcagaatttcgtatcttttcctcgtccaccacatcctcaatcaaagccctgaggggagcaatatcaaagccgccgtccctcagaacccgtatggccccggctataagttcccccacattaaggggcgccagactggaaatattcttaaggctgaattttgtcagacgttccataagttcatcatccacatccatgaccctggagtagctgatattctcccagatgcgctctgccttttcaaaatcatccatgcaaataagggcaccgttcaaggcgcccaccgaagtacccgcggcgccctttatcctgatgcccgcttccctgagggcgcgccaggcgcctatctgataagcgccttttgcccctccgccctccaggacaattccatattccttactcaagtccagctgcagcttaatgatgaccacctgccctttcccgcctgcccagcataaatgccaaaggacgtataagaataagcgtaaggaatgatacggccacgaacactgccagctgcgcctccatgggcagtcctgccagagctgccgcaaatccgcctatggcccctgcggcaaaccacagggaagtcaggcatccgaaagccagttccactcccagaaaaatcaaaaacgatacaagccatccaactgataacatatgcaccttctccttcctgcgggcagatatggccaaaagtcctttccttatgctgtctccaccgggacgctgcagcttcttctctgtctggctgtctcaaacataagaacggaagcagcaattgcagcgttcagggattccacctttccctccatgggaatcttcaccaggcagtctgccagcgaggtagcttcctccgtaaggccattggcctcatttccaattaaaaagcccacattgtcagtataatcttcctggtcataattattcatacctttcagatgggccgcaaaaagacgcactcccctgtttttcatgagcaggcaggcatcctgcaggtcatctgcatacatgaagggcatcctgaatatggatcccatcgtggatcgtatcacttttggattatatatatctgccgtatcatgattcataacaatgccggtgataccagcgccctctcctgccctgattatggtaccaaggtttccggggtcctgtatcgtctccagtaccatgatggccagagccctgccgtctggtgctggttttacaatgtcatccatggtatagcgcttctgcctcaccacggccagcactccctggggcgtctgcgtatctgccataacattcatgaccacatcgctgactgtctccggccggaaccgccccatccatttcctgttatcagtgtcccctgcaaagttctccgtaacatacagggcatccacatcctccgggttcagctccctgcacattctgaggccttccaccacatacatgccctcttcccgccgggcctttgctttgcttctcaggctcacaacacgctttacctgtttgtttgatgtactgttaatcatccgtattcattctcctgacactgcttatttgatgccttccagttcctccagccacaacctgcccgatgcgtcgctgggcatcctcaaatcccctctgggggaaaccgccacagaacccaccttaggcccgtccggaaggcaggaacgcttaaactgctggctgaagaaacgtctgtagaacacgttcagccatttaaggatcgtctccctgtcatactgagacttaaacgcctggattgccagacggtaaatcttggccggggcatatccatatctgagtatatagtaaagataaaagtcatgaagctcataaggccccaccaaatcctctgttttctgggaaatctggccgtcctccgggggcagaagttcaggactcacaggtgtatccagcacatcaagaagcacatccgccagctccttttcattgcatgtatccgcatagtagcggaccagatgacggaccagggtcttggggaccgacccattgacaccatacatggacatgtggtcgccgttataggtagcccatcccagggcaagctccgacatgtctccggttccaattaccaggcctcccacctcattggcgatatccatgagaacctgggttctttctctggcctggctgttctcataggtcacatcatgtttgtccatatcatggccgatatcttcaaaatggcgtgtcaccgcctccctgatattaatttcgcgaagttttgcccccacctttccggccagggtgcaggcattattataagtcctgtctgtggtcccgaagcagggcatggttatgcaatgtatgccggacctggggatcctgaggctgtcaaaagccctcacagttaccagcagagccagcgtggagtcaagtcctcccgacagtcctatcactgcttcatggcatcccgtgtgctccagacgcttcttaagacccatggcctgaatggatagtatctcctcacaccgcctgtttctctgtctctcatccctgggcacaaagggagccgggtccacgtaccggagcacatcaccgcccggctgcgtggaaccatgggcctgggtatcctgactccttgcgctgtcctccgaaaccgcatcaaagctgaactccacggtcagatacccgccttcctccctggctgctgcagggtccgggaatgtgctcatgcgcctgcgctcactgtccaggcgttccaaatccatgtcggcacatatgctctcgttgataaaacgtctggactccaccagacaggtcccgttttcagctataatgttctggccaccaaacaccaagtcctgggtggattccccctcccctgcattggcatagacatacccgcacaccagcctggctgactgactgcatatcagctcatggcggtacatgtccttgcctgtggtctcatcgctggcagagcagtttaccaccaccgtggccccggccagggcgtgtctgatgctgggcgggcatggcacccacacgtcctcgcatatttcagctgccaccgtaagttccggcatggtattgcacctgaataaaaggttggtgcccatggggaccttctctccgttccagcaggtcatcaccggccgttcattgcccgggcaaaaattcctggcctcataaaactccgaataattgggcaggttccgcttgggcactacgcctataagcctgcccttttggatggctgcagctgcattgtagagcttcccgtcccgctcccagggaagccccaaaaacaccaggatgtcctttccgtccgtaaaccggacaatacggcccagctcttccttcgcccttctcagcagggccttctgaccaaacaggtccgcacatgtatacgcagtaaggcaaagctccggaaacaccataagcttcactcccctgctgtatccctgaccaatcaagtccataatctgctgtgcattatattgtgggtcagccaccctgacctttggcgtggcagctgctacccttaaaaatccatctttcatgtctggcctccattgaaaataattgttttgatttaatataccacagattggcagaaaaatatagggaggaattgggccggataggtgcataaaccagggaagagtttggggaaaactccccatttacatcccctcaattctattatacaatcataaaaacaaataaaatacaggagttgtttctatatgataaatgaattttccagaactgagatgctcataggcactgaggggatgaataagcttaagaactccaccgtggttttattcggagtcggaggggttgggtcccatgcagcggaggccctggccaggtgcggcgtgggccgcctgattcttgtggacaatgatacggtctcccttacaaacattaaccggcagagtattgcgctccacagtaccatggggcagtttaagacccgggtcatgaaggacaaaattgctgacatctgtcccggcacgcaggtcattacctttgaggaatttgtgcttcccgataatatagaaagcctttttgaacgtatgaagcaccagatgggacagggaaactctgtagattatatcctggatgccatagataccgtgacagcaaaacttgccctggcaggctttgccgcctcccacgctatccctgtgatcgcttccatgggtaccggcaacaagcttcacccggaactcttccgtatatccgatatctcccagacctctgtatgccccctctgcaaggtaatgcgcagggaactaaaagccaggaatatcaggggactaaaggtctgctggtcgccggaacagcctcttacccccggacagacggcggaggataccgggtgccgccgcgccactcccggaagcatttcttttgtaccgcctgtggccggacttgttattgcaggagaaatcataagggatatctgcgggctggcttagccgcagatatccctcttcgttatataatgattcataccggccctattccagaggcgcccggtaaaacctgcctacaaactgctgtgtcctcagcacattgataatgatatgttcatctgcttcctgcatgatatggatggcgttgtttacctcataggctgatatgactgtatttaaaaggtacattttctttttgctgtaccctcccatagcttccacacaggacattccatggcggaaatggctgatataggcgtccaccacctgctgtcccttcatggtggttgcctgaagggtaaccagctcatagcggtggtggaaggcggaaatcatgcgtgtggagatgaactggaagataatggagtatcccgcgtgcttccagccgaaaatggcgccgtaaaaacagtacataacagcatttccaaaaaacacataggaccagatggagagcccggtgcggttggatacaaacagggctataaagtctgtacctccggtggacgcatttcccctgagagcaatgacgattgcacttccaaaaatgacgccgccaaaaataacattcagcacctcatctgtaaagataggactgaagttgaatatctgcagaaaaatactgcttaagaatacctgaaccagggaaaatatggtaaaacggatgctgattcccttacagcacaggattgccaccggaatattcagcaaaagcatggtgacctgcatgggaatattaagccctttcaattcccccagccgctccacaagcatggccatgcctgtaaatcccccggatatgataccggccggccgcacaaaaacctgcagtgcataggactggatgagggcggatacaaacaccgcagccactgtgatgccggttcttacccgcctgtctttcttccattgattgataaaagctgagattctcagaatctgtcccataggaaaattcgctcctgtttcatttagttatcatatcacataattatccttcatgcttttttgccactggaccaaatcctccaatgtatatttatccaccacgccgctgatagcctcatccagctcccgccacaggcgcagggtcacacattccatctgtctggcacaggggttctcatccccgctcaggcagtccaccggagccaggcttccctctgtgattctcaaaatggaacccaccgtatagtccgatgacggtctggccagataatagcccccctgatttcccctgatgctgcgcacaaatccggctctggataagatagagataatctgctccagatatttaccggatatcccctgccggttagctatgtcttttattttaacgggctctacgtctccgtggatggctaaatccaccatggtgcggagagcataacggccttttgtcgatacaagcatgtatgttcacgtcctttgtcttaaattttatcctgccatgagtatatcatactattcctgtaggaaatatgtcaatagtaagttatcttccctgccaggtctgcctaaatgctttatgaatagagtgcactattttcgggaaaataatatggaaactgagaaaaattgcaggtccgattccataaggccggcctgctgacgattgagaacggaggattttcatgaagaatgaaccggtattcctgactgacaaaaaccacaatatagtgttggaggccctttcaccagctcccaatgcagctctccctgattcctgcaaaccctttgaaatcctggacccggcggccactgagggcgcagcggaaaaacatcttccggtagtggaacaggacggactccacgtgacagtcaaggttggaaacattttccatcccatgggtcaggagcacagcatcggatgggtgtgccttgtgacaaaagccggctgtgtcatgcgtgttcccctgacccctgactgcgaaccagtggcatccttcaccctggaagaaggggacgctcctgctgctgcttacgcttactgcaatcttcacggactgtggaaaaaatcaatctgattccttccggcataacactccccagacagccccggatgacagtttttatacccggggccattaccggggcagaataccggaagaatcaggacaaaaaaatgagagccgcccttcccccacagaaggcagctctcagtcacgatcaaaaaccgtcacactattagtttatctggcatccccataccaaacaaaaacccgtaaggcactcctttgtgcttcttacatggacactataccaccgctcccatgatttgtcaatcatttttgtgcatattagtgaattcctttcccctatatacaagtttttatataaatttctcccatccgtccgcagaccaaagacaaatgtcttttgtatatttatctttcatcggtacatactaacttaagccataatttttatctgaagtcacacagaaaggaagaaaccatggaattttcccaaaatttaaaagacaacattacctaccttcacaagaagctgaatgtagagacgaattttgacgtggtttaccgcgtagtccacatcggcggccgggaagcatgtctttatttcatagatggttttacaaaggatgattccctgttgaaaattctgcaggtattctccaccatcaagccggaggatatgccaaaggacgcccacggcttctccaaacagtatgttccatacggcgagatcggactgctttccaatgaccaggatatgaccgtccagctgctgtccggtgtatcctgtctctttattgacggttatgataaatgtattacgattgactgccgcacctatccttcccgcggtgtcagcgaaccggaaaaggataaagtcatgcggggctccagagatggctttgtggaaaccctgatttttaatacggccctgattcggcggagaatccgcgatcccaggcttaccgtggaaataacatcggccggagagagctcccacactgacattgccatctgttatatggaaaacagggttgataagcagctcctggataaaatcaagaaacggattcagaatctgaaggtagatgcgctgaccatgaatcaggaaagcctggcagagtgtctctttccctataaatggttcaatccattcccaaaatttaaattttcagaacggccggacacggctgccgcctcaattttggaaggaaatatcattatcctggtagacaactctccttctgccatgatacttccctcctctgtctttgatatcatcgaggaggcagatgattactactttcctcctattacaggcacttacctccgtctgtccaggatgaccatatctctgctgtccctgcttttaacccctacatggcttctgttcatgcagaatacggagctcataccggactggctggcatttatccggctttcggacccgcttaatgtgcctttaatatggcagcttcttatactggaatttgccattgacggcctgcggctggcggctgtcaatacccccaatatgctgaccacccccctcagtgtgattgccggtattgttctgggagaatatgcggtaaaatcaggttggttcaacagtgagaccatgctctacatggcctttgttaccattgccaattattcccaggccagttttgaattaggttatgccatgaaattcatgcgtatcatcatattgatactgacatccatcctgaatatatggggatttgtcatcggaattatcctgtccgcctgtgccatcatattcaacagaaccattgccggaaagagctatatttatcctctgattccatttagcctctcagaattaaaaaagcgttttctcaggggacggctgcctcatacagagaaataattgtcctatcccatggtaaaacagaatagagaaacagtgaaccggccttttggccggttctgcttcttaactcatattgttatacatatcaaaataggcctgcgcctctttttctgtcaatgaaaaatgtttctccagcttggtcagtatgacttttttgtctttcccctcttccaggttatcttttataagggctttaatgccctgtgacaaaccctgttccaagccctgtgacaagccctgcgtcaagccctgtgacaagccctgttccaatccctgcgccagcccattcttctgcgcatcttctgctagcctcttataatagctttgcatggtagcttcgtcactagctgccttaaggcgctccaggtacagataacgcagttctttgtcggcattcaggcgttccagttcctccaccgcttccttcatataacggtttctctttgccatatctttaagcacctcccagtcacgggcagatataagctttgcccagtgatatacctctgtttgtttttcctcctcactgcaggaaaccagttgacttaagtatagcacacgcaggctgattttgccactatagacacgcccggttttatcatccataagccgtatgaccgaataaaaatgctctgttcccttccgtgggaatcccaagatgctgatatgtatacactcctccaacgcatcataattctggcctttcaaaaaatcttctgtatacatacggctgatataaaagaggctccgttcctcccagaaaggatgtgacaaaagctgtatttctatattcacttttttacagtggttgaggcgcacctttacatccagtattccttcccggtcctcagcatattccccgtgaagaaatgtgtccgggaattccagactggtgatctcacctgccggaatgtccagcagactgcttaaaagccctgtcagcgcaatcttgttgcggaaggttttcttaaaggcgaagtcattggtcaggcttatatccagaggccttccgctgtctgccagctgttttagctgcaaatccacttttctctttccatccctaaaaaaacctctgatgcgccctttgtgccattttcccataggcattgccctccatgaactatttgatttatgtgatatgagcggaaataccggcagatacgccagtctccggcagaaaacattggattttatgccggaaaagatttttatatagattgttcagaaacaatctgattggtccagtatagcatataaaggtactgctttcaatatctcccctgcttttaaactgagaaattacgctttatatccatgcaaaaagcagcgccggatcccttccctttgccaaaggagagatatccggcgctgccaatcttctgttttaaatcatagccattacagcttatccgcatttctgaacagggtatggccgtttgcgttcttcaccagaccggtcacatccggctttgccaggacgatggcattcagataatacagcggtataatgggcatctcatccatcaggatggcctccgcctccttgaatatctccatacgcttactgttatccgccaggttgcggcattcttctatcatgctgtcatacttcatggcattctcaccgctccaacggttctggttgtaggcgcgggcctgggtaaagcagttcaggtttgtgtcgggatccagatagtcaccggtccatccgtcaaagcaaacatcaaagtttccggccttctgctcatcccagtacacctttgactcaaaggtaacaatgtctgcctggactccaagattatccttccacatggactggattacctgggcaatgtccttattctcttttgtgttggtaacaataaaggtcagaacaggcagtccctctccattgggatatcccgcgtctgccaagagtttctttgcagcttccacatcctcttgaatcaaatcacctgatacggtgcggaaatcctcggaggagccttcatatggtatcccataaggcacgaatccgtaggccggctcaggctttgacggaacgatggactcgcagattgtcctgcggtcaatagccatggccagggcccttctcacatccggattggacagatactctttggaacagttgaaatcgtaatatctggttccaatcttgtcatatcctttcagctcttctgtatccccatactggtcaatggcctgggaagttaccaggttatcgcccatagcgtcaatctcacctgcattatatgcggacagggctgactccggagactggataatcacgatttccactccgtccagtttgacggagtccgcgtcatagtaattgggatttttcttcagcacatagctgctctggggatttatcttctccagggtaaatgcaccgttgcacacataggtatccgcggatttggtccagggatcctgtccctccaccacctcctgcttgacagggaaaaagttgctggacgctgtcagataaaggaaatatggcgtaggtgctttcagggttacctccagggttttgtcatccacagcctttacccccacatcctgggcagagccgccctgtgtgttgtattcttccccgccctttagatagtgcagttcccaagcagccggggaagccgtatcaggattcaggacgcgtttccaggaatattcaaagtctcctgccgtcagatcacttccatcggaccatttaagtccgtccttcaatgtgaaggtgtaggtcagaccatccccgcttacctcatatgtgtcacacatggcattgctcaggcttccgtctgcctccagctggaacaatccgcagaacatattctgcaggaaggtggacgatgtgctgtagttattcagtgtggggtccagtgtttccggttcctccatcacagcataggtaaggatcttttctccctcttttgacccggcgctcccagctgccgaagcttctgtaccggcatctgttccggcaggactgctttgtgcctggccgcagccggccagggtagtggctgtaagggctgcacacagcaataggcttaattttttcttcataacatttcctcctagtttttaaccggattcccgtttggcagaatccaatacaggaaattatacctgcattctccgtggaaagtcaatacatggaaagcagtttggctgggccggccacgtcaccggccacctccccgtcaccttcctgccacctccctgccaccttcctgccaccttcctgctaccttcctgtggccgggcacctctcctactccagctccaacccgcctgtatacagctggtaatacattcccctctcccttatcaggctctcatggtctccccgctcagcaatacgtccatggtccagtaccatgatagcgtcggaattgcggatggtggaaagcctgtgggctatgacgaatacggtcctgcccttcatcagctcatccatgcctctctgcaccatagcctctgtcctggtatcaatgctggaagtggcttcatccagaatcaggaccggaggatctgcaatggctgcccgcgcaatggctaaaagctggcgctggccctgggacagctcctcgccgtctcctgtaagcatggtatcgtatccttccggcagcatctctataaactggtcggcattggccagcttcgccgcatcgcagatctccctgtctgtggcatccagctttccataccgtatattctccctgattgtaccggtaaacaggtgggtatcctgaagcacgatgccaagagagcggcgcaggtcgtctttctttatatggcggatatcaataccatcatatgtgatagagcccttctgtatgtcgtaaaaacggttaatcagattggtaatggtggtctttcccgcccctgtggctcccacaaaagccagcttctgccccggcttcgcatacaggctgatgtcatggagcactgcatgccccggctcgtatccaaagtccatatcctgaaaccgcacatcaccggtaagtcttgtgtaagcggccgtgccgtcctcacggggatatttccacgcccacaggctggtccgttccgctacctctgtcatttttccgctctcatccacacggacattgacaagggtcacatctccctggtctgtctccggttcctcatccatcatattaaaaatacgttctgcccctgccagggccatgatgatggagttggactgctgggatatctgggcaaagggctggttaaagctctttgtaaactggagataagaagcaatctggcccagggtgagccctgccaggccgcttagtgacagaatccctcctgcgatggctgtgagcacaaactgcaggttgcctatgttggtaatgaccggcataataacattggcgtacttgttggcatggaatgcgctgtcatagagccggtcattcagcttgtcgaattcctcccttgtctcctcctcatggttaaataccttgatgaccttctgtccgcttaaacgctcctcaatgtatcccgtcacctttccgatagccagctgctgcgccacgaaataccgtccgcaccggcctgccagagtcctgctgacaaagagcatgagaactatcatggctgctgccaggacagagaggggaacgctgatacctatcatcaccgcggatatggctatgatggtgacaaaggaggacaataccatgggcagagcctggttaatcatctgtctcagggtgtcgatatcattggtatagcggctcataagctctccatggggatgacggtcaaaataccgtacaggcagcgtctgcatatgctcaaacatctcatccctgatacgcttctggacgccctggccaatatttatcatcagacggttataagtgtaggtacaaataaccccggccacataaaagaccgccagccctgccataacatggttcagaaccgtaaaatcaggacgctgctgccccaggagaggggtgataaaatcatctatgagcaccatcaaaaacagcggtcccgccacattggccagagcgcttatgacaatggtcaccagcacacagacaaactggagcctgtaagtgcctgccacataccccataaggcgttttgccgttttggcataatggtggttcacggctgcatttttcttatttcccatcatgatcatttccccctttcttctgggattcatatacttccctgtaaatcttattcctggcaaacagctcctggggtgtaccaaaatcatccacagcaccgtggttcagcacgatcaccttatcagcgtcctccaccgaggatatcctctgtgctatgattattttggtggtgtcaggaatctcctcccggaacgctctgcgaatcatggcgtctgttttcgtatccactgcgctggtagaatcatccagaatcaatatcttaggcttcttgagcagggccctggcaatacagagcctctgcttctgtcccccggatacattggttcctccctggtcgatataggtttcatactggtcgggaaactgccggataaactcgtctgcctgggccagacagcaggcccgcttgatttccccgtctgtggcattttcattgccccaccgcaggttttcacggatggtgccgctgaacaggatatttttctgcagaaccactgccacctgatttctcagggacttaagcccatactccttcacatcccgaccgcccactttaagacagcctccggtcacgtcgtacagccttggtatcagctgcacaagagtggttttggaacttcccgtccctcccagtatacctatggtctctccggattttatgtggatatccacgtccttaagagccagcttctccttatctcctatgtagctgaaggacacatgctcaaagtcaatgctgccgtccgccacctcctgtaccgggtcatccgggtctgacaggctgctcttttcatccagcacctccacaatacgctctgccgaagaacgggccatgatgaccatgacaaacaccatagagagcatcatcaggctggacaatatctggaccgcatagataatcatgctggtgagctcacctgttgtcattctgcttcccacaataagtctggctcccagccctgataccagcaggatgcagttatacatgcagaactgcatcagcgggctgttccaggctacaatcttttccgcatacttaaactggtaaaagacctcctgggatatgtgccggaacttttcgatttcatacggctccctcacataggcttttaccacccggatggcgttcagattttcctgaaccacgcggtttaacacgtcatagcgcttgaatacagcctcaaaatagggatgggcctttatcacaatgtaaaagagccccgctgccaggattggcagcacgataaaaaagatggtggaaagctccctgctgattcccatagccatgattagtgcaaaacagagcatgatggggcctctgatagcaatgcggattaccatttggtacgcattctgcacattggtgatgtccgtggtcagacgcgtcaccagactggaaggagaaaagcggtcaatattggaaaaagaaaactcctgtatgtggtggaacatatcctttctcaaattccgtgccataccggccgaggccctggccgcatttgtccctgccaggataccgaataccagagccatcatggacataactaaaagcacggctccaatcttcagaatatagccgatacttcctccgctcatccccttatcaatcatcagcgccatgacgccgggcaccagaacttccataagcacctccagcaccacaaaaaccgggcagagaagagatggctttttatactcccgtactgagccaagcaaagcccggactgtcttttgatgttgtcctttcactgttaaaacctcctttttttgtaaattcccttggattttggggcaatttaaagagcctaagacggcgccgcctggtggcagccataggcccttccccattacttaagattcttcatcattttcatcccgattcggatgaatgtatccagttcttcctttggaatatcccgtgttatgaactgttccatttccaggatatccttaagcacccgtccttccagctcccatcccttttcagtgggaatgatttttttacacctggcgtcataggacgcctcctccctgtaaatcaggccctttcgctccatcagcttcagaatctccgtggccgtggggcggcgcaggttaaattcctcctctatatccttctgaaacaggtcctgctccctgcagcggccgagaataaagtgcaggattccgttctgggcaggtgtcagccctcccaccccctcagcgctgtcaatcttgcgccggatcaggttggaaagggtggcgataaggcggacggtaggattaacagccatggaatttactccttttattatatgcagaaaaacagtttctgttagttacctaacaattctaaggcaatctatccggtctgtcaaccgaattcacacaattgtaacagctccggcgccaggcaggaccggtccggtaaggttcaggagggtttccccgggatttgataaaatccgcatttacaacctggattttcctgttataattggtaggggtgtcttatcccaattcatattctgagaggttatcatgaaacacaattcacatcaatttcattgcggactaaaagacggcatacccatcggtctgggatacctggccgtgtcctttacatttggaatcatggcaaggggagccggcctcaccaccctacagtccgttgtcatgtcctttacaaacctgaccagcgcgggacagtttgcagcgctgggaatcatacaggccggggccccctttatggaaatggcaatagcccagctcatcatcaacctgcgctactgtcttatgtcctgttccctgtcccagaagctgggcgcagacatgcccttcttccaccgtttctttatgtcctatggagttacagacgagatattcggcgtttccgtatgccggcccggcttcttaagtcccttttacagctatgggctcatctgtgtcgccatacccggctggaccctcggcaccctgttgggagctgtttccggggaactgcttccggcacgccttttaagcgccctgaacgtggcactgtacggaatgttcctggccgtggtgattccgccggccaagacaagcaggattctcaccggcgtcatcctggcctccatggccttaagccttgtgtttgcccatgtccccctgctggcaggtctatcatccggctttaaaatcatcctgctaaccatcctgattgccggtgccgcagccattctgttccctgtaaaggaggaaaatgaacatgaatcataatgtgtacctgtatattcttgtgatggcaggcgtgacctacctgatccgacttcttccgctgaccttgattaagaaggagataaagaacgtatatgtcaagtcctttctctattacgtcccctacgtcaccctgtccgtcatgacctttcctgccattctccacgccacagcctctgtgtggtccggcgcagcagccttggcagtggctgttcttctggcctggaagggaaagagcctgttccaggtgtccctggccgcatgtgccatggtatttctgctggaactgtttctgtaaataaaactgtttcacatcccaggactcctacagcgacaatccgcctcttgcccttgcccgtctgtccatgatggaatggatgacaggaaccatgaatatggccacgattccgcctgcataaccgttattatacaggttcatgcccccatacacgattcccacattgagggcaacggaggaatgcaggtagcctgccacgattccggccaccacgccgaattcacccgccaccggcgcaagggtggtggagaataaaagggccagcatgggggatggctgataaatgttccatgtcttggtaaagctggccagatatacccccatcatcaccggagctatgttcctcagatgttttcccgtggccccaaagcccacaatggtgaagattccgcagatggtaggtccgttcagttcacctcccactgccagtacaaaataggtggcaaacagtccattgactcccatgttgaacacagtgctggcaccgccttcatctctcagataatctgttccgccgattccataggatttgataattcttctgtaagattcccagatacttctgccccgcaccgcaaccccgaatacaatcattccgccaaatagtacggacagcacgattccaaagatctcattgtttcccgtggaccaaatgagcctggattctatctccactccaagggattttaacactgacacaatgaccgtcgctatgatacctgcggcaaaccccacattgtacaaagaataccctttgtgtgcaaaatgcacatgagtggaaaggggcggcagcacaaagcctataatgagccccacggccagggctatggccatccgcatcaccaccggcaggttgcccacctgcatcatctgggtgatgatgggcgaaaggctggtgccgtaaaagccaatataaatataccttcgcatggacgtcttgtgatacctggcgtacaggtacactccggccaaaatagcccagatgttaagcaggtttttgccaaacagcgagaaaccgaacatcagacagctggaagtgatggtgtggccgtccatatccatacccatgaagtagatgatgccaatactcataagagtcagtgcaccggcgttgatgagggccgcccccacaccgcccacaacaaaataatccgtaatcagaaaatccggctcttttatcagacgcacgattcccggaccaatttcctggattggctgcagaaacagcccaatgaccataaaataaacaggaagcagcgacagcagaaaaaacttctgcttcctggtcagggatttcagttcatgaaaatgttccagatgtttcataaatacctcccaatcaacattctttttctatcataactgatagacccccggttggcaaagacattttttacttctattggaaaatttattattatgggttaggttaggcatatcccggcatatttactgttcaggcacagaaggcagccgaaacattcttccatcaactgccctcaaaacaaaaaaagcgcccggtcacccgggcatcccacatctcattttttcctattttccaaatatcacgaaccggttatcccttaacatcttcacaaacttggccagtcgttcatacagcggctcagcctggtctccgaattcttccctgaccagcgctccgatggcaatgatattcctgtttccgtccatctgcttccatacaaagcttccgaaccggtccagcttcacatggctcaccctgggagtgacccacagcttctgggccagcttatcaaagattcccttgtgcaccatatccacggtcacgattccctgctggtcctctttccatgagaactcagggttcctgaccggtatcttttccagataattctggttttttttcttattgaagcccaatgtaatccttccttccatcaccgcctgttcataaacatgcacagggcgccaggatacctgacaccccatgcacacagaacccgcactgttataccagtatggttatttcctgttctctttatgccagatggtaaatttacacatggtaagcatcagtaacccaaagacaataagtgatacaatctttgccgccggacttaccagaaaagcgcctaagccgttatccatggcagacagattgataaaatcgcccagatacccgccccgcgcgcttgcaagggggatgatggcgaatacagccagcaggattccgaccagaccttctcccgcaatcatgcccgatgtatagagcacgccccggtcaatggcctctttcttatcctcttcctttgcgtatttacgcttttcataccagtggcggatgagtcctcccaccatgatggctgccgtggtcctcagaggcaggtataaacctactgctaccggcattaccggtatcccaaggatctcaatgacaacggcaatggccgctcctgccagaatcatgttccatggaaggttgccgtccatgacgccctctaccacggtcttcataatcatggcctgaggagccggaagttccgccgagccatagccccaggcctggttcagaaggtaaagtacgccgccgatggcaatggcagaagaaaccacgccaatcagctctcccatctgctggttccttggagtggagccaaccagataacctgtttttaaatcctgggaggtatccccggcaatagctgcaataacgcagataacaccgccgatggagataacgcccatcatgctctcatgggtggcgccggacacggctttaagcaccagcgccgataccagaagtgtggcaatggccataccggataccgggttattggaggatccgaccaatcccaccagacgtgaggacacggccgcaaacaggaaaccgaacacagcaatcagcatggcgcccacaaagtttacaggaacagccggcaccaaccatatgattaccacggcaatgaggacgcctatgagtaccacattcataggaatatccctgtccgtgcgcagggtggaagcctgacgtccgccctttaagtcccgcatggcatccctgaaggtattcacaatcatgggaagggacttaatcaggcttatgatgcctgccgctgccacggcaccggcgccgatgtaacggatataggagccccacatagcctggctgctcatctcgctgatcagcacatcagccggtgcaaagggcgctgtgagtccgcttccgaacagcttgataatgggcatcagaatcagccaagatataatgcctcccgagaacatgtaggaggaaatcttaggaccgcagatgtaacctactcccgcaagggcaggaagcacggaaatccccacgcctccgccgtatttttggatatcataatccacatcgctggggaacagcttcaggccgtcagccacaaacttgtacaaagcggcaattcccatgcccgcaaatacaacgcctgccttggaaccgccctgctctcccgcaatcagtacctcggcacacgcctggccttccggataaggaagcaccccgtgctccttcacaatcagcgcctggcgcagaggaatcataaacagcacgcccagcacgcctccgcacagcgcaatcagcgcaatctcaaccagggaaggcgcgccctctccccactcactcatccacataaacagggcaggcagggtaaagatggctcctgctgccacagattcaccggcagaaccaatggtctgcaccatgttgttttccagaatggaatcccttctgaggattacccggataacacccatggagataactgccgcaggtatggatgcggacacggtcataccgacgcgaaggcccagataagcattggcagcaccaaagagaacagccagaaggatacccaggatcacagaaaccgcggttacttccggaaccaccttgtccgccggtataaatggtttaaaaccattttcatctttcatgtatctatcgctcctttcgtattgaccacataaaaaccggatattttggctcttacgtgagatacaagccaaccctgccgaaacaggacggcttgtatcttatccccgtaattatagcatccttcagaaaaaatttccacaatttttgtgtaaatggtaagaattgcattaatttttttaatttttccatcatttttatttaataaaacggccacaaaaccttacaaaacaaagtattttctctgttttgtggcctgtggccggaaaaaatttccgaaatccattatttttcacaatcaaacacaagtccccaggaagcccttatatcatccataagtctaagaatgtccagtgtgtcctctttcttaagtacatcgctggaggacatgcccagccggacacacctgtttacttcccgtatctgatactcaaaaccgtttacctcaaaatgaaaatccaggacatattcctcccccttcacgggacggataatcagccgttctgccttctggtaatccggcagataaatggatcccccggacccgaacacggctgcttcccttggcatatccatgccgatggaggcggtggccgccgccctgaaaccgcctggatatcggagcagaaccgtgctgtaatcatcggtgccgaattcattcagatgatactccgacacaacatgttccggctgtttatctcccataaccatgcgcagaaatcccaggttatagatgcccacatccagaagagcgcctccgcccagcccggaatcaaacttgcgcgccttccttgccccttcagccacaaagccgaaatcacacctggcaaatcccacctggccgataactcccccgtttatcagctcctgcatctttttcagggccggaagatggcggatccagaaggcttccatgatgaacaggcctctttcctctgccgcggcgaaaagccgttccccatcctttacattggtggtaaagggcttctcacataacacatgctttcctgcttcaagacatgccatacagtttgcataatgcatattgttgggagttgccacatagaccgcgtccacctcttcgtccctgagaagctcctcataggagccatatgccctgggaattccgtatttccttccgaaagcctccgccttttcccgggaacgggaaccgcaggccgccaatcggtcctcccccttcattccatttactgtttcagcgaactttgccgctatggtgccggttgccaagattgcccaattcataaaagatgcctccaactgttttatttatgcagtatgtttcatcaaattcactctgaagcgcgtatgaaacacactctaatgcttcatcttgtgtttcttcctgtacatgtaagtgtccgccctggccagcgtgctccccaggctcacatccttacccgggtcaaagaaggcatatccggccgcaatgccggccgcaaatacattcccgtcgctgtaagccttcacagccctctccatggccagaattccacgggtcacctgctcctgtcccaaaccgtctaactggaccacaaactcatcccctccaatgcggaacaggggcgcccccggaaacgcttcccgtataatgtcagcggacctgcggatgtattcgtcccccttgtcatggccgaagcggtcattgacccccttaaggtcattgagatcgcacatcaggaaaccgcttcccggtatctcctccggatggctgttcttgtgctgcagcatgtgttcataagccagcctgtttccaacacccgtgagaccgtccctgtcacgttccaccttaagcgcttttgtctcaaggatttcatccgtcacatcctccaccacgcagcggatgggatggactgccgtcttacatgttatcttaatccaccgggttccttccgcggtatccatctttatcacaccgggtcctccgtcccgttgtgaggcaaggctctttaggaaacgtatgaattcatccttatcccgggaaaacaggtgctcctgctcctttgtaagccttaaaagcctgggtatctggctggtcataagcaccttggaggaacgccctgatatctcaaaggctcccacaggaagttccgacaattctatgagcttggcatgtctggcaaaccactggctggtaaacacggcaataataagtccggctgccatggaaaggaccagggaatactccagaatctggccgattctgcgcggaaactgcaagagcaccggttcctccataagtccgatcaggtaccactcatctccttcaaacggggtattgtggtagtacatccccatccggttcacgcaggcgttaatcttccggccggtccggtccgtgttcagcagggtatatatggaattttccttgtccttaagctccatctcaaacttgcggtcctgccctgccagctgtctctggagggcgccgtaagtaaccgctgtctccttcttgtcctgctgtgaccggtatccgatgacataaccgtaggaatcccctgtctgaagttcagaggcgggcaggaaccggtacagatagcttacggatatctccacgccgaagacagccagcactctgccgtcctgtccgaacaggggaacggaataggtaatcacatcctcatctccttcgttcacctgaaaaggcggactccagtatcccagccatttggaccgcccgttttccactgccgcgctccagggcttttggaaaaaatcgcggttttcctcatttacctccagccggaagttccagttggccgtggtggatattttcattttttcggctacgttccacgggccgatgagcatatacagattttcattctggctgctgttgcggtccggattattattcctgaagtacagggcggccagggagccgtctgtctccccttcgtccggcagtattaagaacacacccgtggtctttgtgtcgtacagggcatccaggacctcaggtgccagcgcctccagcatgcggtccggctgtccctgatattccagcccgtccggactgtcaaaatacctgcttatggtatctgtatgatggctgaaattagtccagacattcttcatctggttttccagattattcctgcggccctttaccttttccgcaaatatgcggtactggttggcctctgcctgttccataactccccccaccaccataaaggacaccaggagcacgctttgcagtaccaatgataccacaaatgctatggtcagcttaaatgctatggatttacttctgaattttctgtccatctgtcttaccagccatttcctttaggagtgtttcataccaatggttaaaatgctcctcatccagcagttccctttctacagactccctgctctcacctttttccatccgctgcttcagggtttccaaatccacattcacacagttctccagggatgtggaaaatatctggtccatatcataagaccccccaaaggtttcccggacatatacattgtgatttttcagggctgtaagtgaggtcccgatgctctgctccactgcctggacattgtcccggctttccacatgggacaccagatctgatacggattccagagccttctcctgcacaggcagatatcctgtggccactgcaaaacgtatattctgctccggctccgtaaaccatttaaggaaccggaccgcagcctgctggtggctctcatctgaggcaaacaccgccatgttggcccctctctgtcccatataaggcgtaccatcctgaaaaacaggataggcatagcttttgcaggaaatgggatgggactgtttttcatcctcaatcaccacctgcggaaagaagcctgcgcctgccgaggagccgatataagccatcagccgcccgcttttaatgccgtcctggttgtaggtcctgctctcgtaccagccctttatatggggtacatagtatgcgtcccatacccgcctggccgtgtctttggaataattgaattcaggcccatcctgcgtccagcggataccctctcccagctgggcggccgacagtgcggcaaagtcattgaatgcgttcatacccaggaacggactgcccccggaccattcataatacatgcccgcagcctgagccaggccctcccaggtcttaagcatctctttgtccgcgcctgtgtccccggcaaacgtttcccaatccgtttcattgagatagagaatctccgtggattttgccaccggaatcatccggtgaatgccgtctccttcccagaccccctccttcaggaattcgggccggtaagcggccagttcttcctccgaaaaatagtcatccagatgaaccaggggcactattccgtccagcctgtacgcgctgtccggataggatgaaaatatatccggcagcgggtctgagcctatgacacggctggcggatgcgtacagcacatcatccagctcattgctggagccgtatcccaccggttccactataattccctgctccatgcccactgtctcgttaaattccatcaccaggtcgtcaaaagcccccttggccactgcattataggaatgccacagcactaccaccaccggctttccgttatcttccttttttccatctacggccatgcagccgccaagccccaaaacagcggccatgacagccgccagcatatgtacacttgatctgcggttcataatgaattacctccccgtgcagtcccccatggcaggcacagatgccgccattctccaaacacgttacatcttaagtataacacgcggcacggcctgctgtctattctggatgtatgataacagaatctgagccgcccctggttccgggtatatcgggattcccagctctttaacctttgaatccagggtctttaccagcataggacccgaggctgatgttttattttattatggaatttctgaatatgcaagaaaaatatggcgagaatatccgcagaaaagattgggctgagtcagaaagaaaatggagaaggcggccggcatgatacagcatccgcggaaagaaaaagacaggacccccaatggccctgccctgttctgctctttctatgcctctctgcctgaatgtgagtaaaatgtaatcagatacagtccgcacaatcccaccagcgcatagattatcctggtcacccaggaggctgttccgaaaatccatgaaaccaggttgaaattaaagaatcctaccagcccccagttcacagccccaatcagggcgattgtaagagcggtataatccaatgccttattacccattgcatgctacctccttgtcatgagcattttgcgcctgttctccagacacatatgcagcttgctatacgctggtagtatgtaccggtttgtggaattccatacattttttgctgttttatctccattgctgtttccggcagctgaaggcgcttgtgccggtcagtccttcttatcctctccggccgcctctctcatctgccggattacctcctccggaagtatatcatacaggcggttccgcttaagaccgggctggtccagatattcttccctcagcatgccgtttacccggtccagctcctccttcaactccctggctgatataaggcggcatccctggcccagaatgatgacctgttccactccgtcggaggttgccacggacacatcgaacctgcgggcattttcatgggcaaacttctcgatatactggtccgctgtctcagcctcctttgtgtagaccacctggatattgtggtattcagaaacctccgtggcatgtcccgccacacggtaggcgtcaaaaaccaccatgagacagcacttgcgtatggcctgatagttgcagagcaaatccataagccttcctctggctccgtccatattgtccagggccagctcccgcagctcctcccaggcaaagataatattgtagccgtccaccagaagatattcctgtctggcctcctgcttctggtaggtgcgggtcaccgggccgctgtaggctgcggcgctcctgcttcccctgctcttgccgggatatcctttgcgcgctgacttatcccggctgttggaataaaaggtgcgctccagtatggcgtcaatctcatccgtactcagccatgtttctgcgcaagcgttctgtccggcagaggattgtccctgattccggccggaaaagggactcttctctccctccctctcctccccaccaggggattctattacaataccgctgtccacatgcatgtactccttcacccggtcccagcttaccacaaatccggccccatgggcgcagaacacggagcctgtgggattctccatatctctgtccgggtcgtagccggtctgttcgatgatttcccggctgttatgacagggctcgtatcctttcagcgtacatgccagtcttccctgtcccctggtataggatataacctctgactgatacccccgcatggcggcaaccggcgcctgtcccgtgaggacggcctgtccctgcctgttctcctcgatgacgcaggtcccgcaccgtttctcaatatcggtcatggcacgcccaatggacgcctccggcacttccagacggaaggtataccatggttctaaaagaatgcaggaagcctccataagcccctggcgcagggcccggtaggtggcctgcctgaaatctcctccctccgtgtgcttgttatgcgcccttcccgccacaagggtgattttcatatctgttatggctgctccggtcagaacgccccggtgcaccctctcctccagatgggtcagcaccaggcgctgccagttcctgtccaggtcgtcctcgctgcatctggtctcaaactggagaccgcttccccgctctcccggttccataagcagatggacctccgcatagtggcgaaggggctcaaaatgccccacaccttccactgttccgctaattgtctccttatatacgatgtttcctgtgccgaattcaacctgtatgccgaaacgctcttcaatcaggctctttaacacctcaatctgcacttctcccataagctgcatggatatctctttcagttcttcattccatactacccgcagcaggggatcttcctcctccagctggcggaactttggcagcatcacagcaccgtcgcagccctccggcagttttacctggtaattgagcaccggctccagcaccggaaccatggaatcctgcccggctcccagtccctgtcccggataggtcctggtaagaccggaaacagcgcagatggttccggcctcagcctcagccactgtctcataccggtccccggaatatacgcggatctggtttaccttttcctgccatgtttcggatggcttttcggtatttccgccggatatgattccctttaccttaaggcttccgcctgtaatctttaagtgggtcaggcggtttccctggtcgtccctggaaatcttgtacacctttgcctcgaactcctgcggatagttcggcaccatggcccatctgcgtattccgcccaacagctcctccaccccggtaagtttaagggccgacccaaagaaacacggaaaaagcctgcgttccttaatcaggcggcgtatctcatcatcctccacatccccggtttccagataacgctccaaaagcgtctcatcacacatggcagcgtgttccctgaattcttctgtccctgcaccggcaaaatccgcacatccgtcgtccagacgtttctgaagttctctcattcgctgctcccggtccgtaccgggctggtccattttattgacaaagaggaatacaggtatcctgtattttgccagcaggcgccacagggttatggtatggctttgtactccgtccgcaccgcttataaccagaaccgcataatccagcacctggagcgttctctccatttcagcggaaaaatccacatggcccggcgtatctaacagcgtcatgggcattccctcccatgtcagagctgcctgctttgagaaaatagtgatgcccctggctctctcaagggcataggtatctaaaaatgcgtccctgttgtccactcttcccatcttgcgtatgcttcctgccagatacagaagcgcttccgataatgtagttttcccggcatccacatgggccagaattccaagtaccattgatttcatatcctgtctctcttcctgctgtcttatgtcccttaacatggccgtacatccaccgtattgtcgttaagagtggtggctgctcctatatcggacagccgttcatggtggagggcattgaccagaagcccgtcttttgtaaaggtcctgtcgtaaacgccctcggccgcggccgttccttccgccaccagaggcgtgattttcgcggtaaactccacctctgccagatcattaaaggctgtaacaagactgccgtccccgatgtttcttgctgccgcatcttctggatggagcatcagcgccatgggaccccggcctgactttaagtccttcctgtccataaagaccgaattcagcgtgtacgcgctgggtaccgccaccagccgcagagggtatgtacccccgtggctcttaatatacctgggcatggactcctccaggttttcattataaatcatcattttacccgcaggcgtcctgaagcttccgtggtctgcaaatgcagtggatatgactcccccgtcccttaatatgcgccgttcctcctctgagatacaggataatccctccatgggatgggccagaagctcctcaaccatttcttcctctgtcctcttaaaatattcctcctcatatcccatggcctgagccagaaggcagaaggtattccaattgctcttactctgcccggccggctcgatgatttttccggctgttccaaaggtacagtatccgtacgccgtatacacatcagtctgttccacggaaaaggcggcgggcagcaggatgtcggcatacacggccgtatctgtcatgaaccgctcatggaccactgtaaataaatcagggcgcaaaagtccctccaggattcccttctggcagcagacagaggccaccggattgcccccatagacataaaagctgcgtatgggcttctctcccctgctccctgtaagggcagaggcaatctcattgatattcaccctgcgtcccggttttttcctgaaatccggcctggtaaccagccggttgtccacatagggacccgctcccggattacagccgcacaagccgcccccgggacgcccccaggcgcctgtataagcagacaaaatggtgataaggcgtgtggtcattcctccgtttccatagcgggagggaccgcttcccagaatgatggccggagcctgggcaaaggcatattcccttgccagaccctcgattacctctgcgggtatgcctgtctccttttccgcccaggcaggggtgtatggggccagggttttcctgaacgcctcatacccttctgcctgacgggtgaggaaatcccggtccgccaggttctcttcctccatcacatgcatcatggccaatgccagggcgccgtccgtgcccggacgaatcagaatggtctggtcgcagtatacatccatatctgccgcgcaggattctatgagcaccacccgtttaccctgtctgcgtgcccggatcagcgccggcatggactgaagcctggtggccttcatattgcttccccataccaggtaaaagctgctgtccgaaagctcccttggatccagacagcctgtctgccccatgaccgcctcatagcctgctccctttgcggaagaacacagtgtcctgaccatgtcacaggcccccatccggttgaaaaaggcatccccgcatttgcgctgcaggacgctcataacccctgagtaatacatgggcaggatagcatcagcaccgtcttcttccagaatacggctccacctgcctgcaatctcctctatcgccgcatcccaggttatgggttcaaatctcccctctcccttggcgcccacccgcttcatgggtgtaagaatccgctcaggtgagtggacggactgctcatagtgctgcatcttcctgcatatcagccccttagcagccggatggtccggatcgcctttcacacccaaaatccggattccgtctgtttctgccaaaagtccgcaggatgtgggacagtcgtagggacagattgtttttcttatatatgatgccatcttttgtcactccctctattaccgcgcccggggcataatccggcctggcagaatgcggtctggtatggaccggcgcaatccgccggactctgtacggtccgggcctgttactgcctgaactccgggcgctgttatctgatattaagtatagccagcaatcgcttttccgtcaaactaattttccttcccctccaggcccgtgctgccttcgggactcacctgtaccgaacagtgtttgacctgcggaaatcttgcttcgatggtatcgtggacttcctttgcaattgtgaaggcctgctccagcataaggcttttgtctgcttcaatctccaggtcaacatatatcctggaaccgaaaagccttgttttcatggagcccacacgttccacgccccgtgtatctaacgccgcctgctctatggacctgacggtctcctcgtcacacgccttatccaccatcttatccatggaatccctgaacacatccagggctgcctttactatgaatatacagatgacgaagctggccaacgggtccatgaccggcactcccattctggcgcccagaataccgataaaagcgcccactgaggacagcgcgtcgctgcggtgatgccatgcgtccgccatcagtgcacctgattttaatttcctggccgcagccctggtataccagaacatccattcctttaccacaatggatatgaccgcggcacccaaagccagcattcccggaacattcctgctcccttccgttcccgaaccaatggtttccacagcgctcaccccaatggcgattcctgtggcaaacagtacggctgacagtaacagagccgccacgcattccatccgctcatggccatagggatgttccttgtctgactttctggaagccatggtaattcctgccatgacaatcagcgtgctgaacacatccgaggcagaatggaccccatccgatatcatggcgccggaatgggccaggatacccgcacctaccttgaatacggagagtactacgttaatggcaatgctgacacaggatacccgcatggccagccccgcaccatgacttcttatctttttccctgaaaccttctgctcattaccttctcccatctgtcatttcctcccatatatatgacaaccacctaatctgacatcccgccctcaaaaatataaaaaacgcctgaggggcaatgtaagtaaaccactgtcccacagacgcttctgtctgctgccgctgcccgcggcccggctcccaaggcagtaaacgcctttggcctgctcagtttgtactgtagattagatatgcagcgcaaagagtgtctttctgcagactgatatgaaagtctgttactgacaggatatgaggaacggttctgtttggtgcggtaatgattgtggatttatccaaatcaggccgtgataaacggatgaaaaaaacagccgtatccgcagaagggagcatatcagtgcccctgtatctctgcccatatggctgttttccattatctaaatatccggcatgaaattttcaaacgtaattaaaagcaaattttaaagcaaatgctttctgagctccgccccatccgcagcgctcaggtaagccggtgcaatgtcgaacacggtcttgcagccggactgcccttccctgctcaggcggtatgcggccctggcatatgacgcaataacagatgcagtgaattccgggttggagtccagcttcaggctgtattcaatcacatgtccgttctcgtcattccatcccgtgctgccggtgcggataacaaaaccgccatgggggattccagcatggtcacgcatcagttcttcctggctgataaagtgcaccgtggtgtcataatcagcaaagtagttgggcatggttacgatggcttcctcgatggcctttaaatcagctccctcctctgccaccacaaagcactccctggtgtgtttatccctggtagtaagctccggcgcctttttgcttctcacagccgtaagggctgcctccaccggaatggtgtactgccttgcgtccttcacgcctttgattctgcggattgcgtcggaatggccctggctgacgcccttgccccagaaggtataatcactgccgcccggcaggatggcattggcatagagcctgttaagggagaacatgcccggatcccagccaacagatataattcccacatgaccgctttcctttgcagccttgtccactgcctcaaaatgccgggggatattggcgtgggtgtcaaagctgtctattacattgaaatgcgctgccatttccggggtctgtccgggaaggtccgtggcgcttcctccgcagagtatcatcacgtcaatctggtccttcatggacagaacatcctctgcccggcaaaccttggccccctcagtcaatatgctgaggctgtcaggattcctcctggtgaacactgctttcagctccatgtcgggattgtgcttaacggcacactccacaccccttccaaggtttccgtagcctaagattccaactctgattgccatatttttattctcctttgtaacgtaatagtgtgggttgtcggtttttgtaaattatactacagccttcttttcttggcaaatcattttttatcactgcaccttgacgcagtgccggtttttgttactttcgctttctccgtcggaaacagacagctgtgccgccaatcaccgcagcagcgaggacagcccctgcataccattttaatccggattttcccgaatcttccccatcctgcacttcctcctttgacgggtcctgctccgtgtccgtgacttcgttttctccctccggcagccctgctgtatcctccacttcatctgccggttggatttgcgggtcactgtccccgttcttttcaccccggccgcggacctgggaaggcgttgcctctttaagcatttcctctgcggtctgtccggcggctgttcccccgtctttataaccgggagctgaatacggagtataggattcccgcctgcggcctccccggcctctcaccggcgcctccggcgcgtcagactcctcctgcatccccggctgggaggaggaatttccccctgatatgctacctcccccatacccgccagaactgctgccgtagctgcctgtgtatcctcctgcatagctgtagctcccgccgtatgaaaaggtgagtccctggccaacggtctctggtatggctatctttaccttgtccgtctcgaagcttccgccgggccactcgatgccggccttcacataaaaggagctgtcccctgactggaacctgtatatgagataaccgtcctccacaatgcttgtattcagcgtgtttccggtttccttcaggaaattctcatactccactgtctcctgcccgctttgtgacgacgcggctgtcaccttgttcttttcctttttccaggaatgtccgctttcactgcgcagtatgtatagggcattgatatcggaaggcaggttcttaaattccagcctggcagaaccgctgccgtctgcttctatattcaaaaggactgcctctgtcagctgaggctgtgtggttccatattccggggtctggctctcaccgggcggaaccggctccggcgggtctatgcgctcatcacggatgtctgtcttcttaagccccacaaaatccttgccttcttcccattccagcatcccctgatttctcaggataatggccggttcatccgaagcatccctttgtatctgtccccgtttcagtgtcaggcatccttccccctcaaccgatatcaggcttttagttcccgttatgaggagatttggattatcaatgacaacgcctgtctgggtcaggttcttaggtgccaggatttttatgggtccctcaggtatcctgatttcaatggggctggtactcgtctggccgtcaggaagccccagggtaagaggttttgtaattaccaggttttttggcagaactgctatgctgtttccccccattaaacgctggtcgtaccattgctttaactggtcttcacctgcaatgtccaccagtacctcccctgtccccggggatgtatccgccgtggggtcacgcacatcggcaaaggctgtgatagcagtgagtcctgccccttccggtcccccccacataaccgctgccgcgcaccgcccgcccagcagccacaccagggcagccagccctgcggttatccttcctatcttgttccttctcctctttccccccgtgtctctgtccattcttttcatcctttaaattcctttcacactgtatcacaaagggagcagctcattctccagcaaaattccaatcctgccgttggaggacagtatgtccgacggccgggtcacatccaccgcgctgccggcaaaggtggtcacccttcctcctgcctcttcaatcagcagcataccggccgcaaaatcccagggcttcagacaacgctcgaaatatgcttccagcctgccgcaggctacataggccaggtccactgccgcggagccggtgcgcctgatatcggaacatttgaggaatacacgcttgatatcctcaaaattccggtctgccagatcatggttataggggctggttccaatggaaatcaagctctgtcccaaatcactgacagagctgacatggatggggcttccgttgagaaacgctcccctgccccgctgtgccagaaacagctcatccctatagggctgatatatgattcccagctccagctgtcccctgtcacacagagccagagaaagggcgctgcacctgaaatcatgaatcaagttggtggtcccgtccaccggatccagtatccatactgcccctgaaaagtcaatatccctgttatccttttcctcccccataaactgtacctggggatacatgtcaaaaagtccgctgcgcatccgctcctggacctgaaaatcaacctgggtcacaaaatccgctgccccttttaccgttatcctggacgccctctcgtggtccataaaaaggggcctcaccgattttaccagctcaatgaccctttgtgtgtctatctccatatgttttacctcctgcagccccataatccgggacatagttcttaacggcctgccacagaaggattataccacagaaacggcttttatgacatatcttcataatccatcaggggccaatcccgctcaatgtaaaacatatcatccatcagcagccagttggccctgaaaaaccgcataagctgccaatacccggccccatacagattaaattccttgataaggtcaaactttgccctgatgctccttgcatcctcataccatacctcatgctggataccatactgccagtaccggaaatagggcgacatggcggtttcatcaaaccggatatccactccgaaatcaactgccagcttcaccgcctccagggttcccagggatttggctctggttactccccgttcaaaaggaagaggccagtcatagccgtagttgggaattcccaggatgattttctcaggaggaatctcgctcaccgcatattccacaaccttcctcaccatattgatgggggccacggccataggaggtccctggctgtatccccactcgtaggtcatcagcataacatggttagccgcctcccccagcagccggtaatcaatgccctcatagagaagccccctctgctgggccgacgtcttaggcgcaagggccaccgtaaccgtataaccaaatatgttgaggacctgggtggcgcggcgcacaaaatcagcatactccacccggtcttccgccagcacatactcaaagtcaatgtccaggccctcgtatcccttttcctgcatggtgcgtcccagctcccatataagacgctgctggttttcctggcttctcaccagggctgataccagattattgttaaaatgcccgtcctctcccaggggcgtcagggtaaggaccgggcggacgccccattgcagcgccctttctatcatccacgcgtcatccgtcatgggaagaaccagattcccgtcctcagtaaaaccataggaaaatacattgatggcgctcagataaggcagggtatcctccaataccacgctgtctataaagggatatgcataaccgctggaaaacaggggccttcgtccctccccggtttccccgtcagagatataaagagcctggccaacggccaggcggtatggatattctatctgatttgcccaaacaagggtctctacgggaatcctctgggattctgcgatggagtcaacactgtctccctgtttcactacatatattttcatgcatttcattcctcaacctgaatttatacaatatatgcagcactgccggtctttaatccaccagtctcctggccatccacttcccgcttcttacgcgcaggaaggagaacaatgctccgatagcccatcctgtaggtatggaccaccatatggcgctggctccgatgaaatgcgccagcaggtaggcaatggccacgcgggagaacaggtttaccactgagctgagcataaacgcccccatgtcgccggctccccgcagcagaccattgcttacgaacagggctcccatcagtatgtagaatacagatacggttttcatatagctgagcccgtagctcatggcgctgccctcagccccctgtttcaggaaaagtcccagaagctgcggcccgaacaggaaaatgatactggtaataataagagagaataccaccaccataaacatgctggccttatatccctgcttcacacggtccattttcctggctccgatgttctgggccgcatagctggacatggcgttggaaaagttcatgttgggcatcattgccagggtatcaatcttagtggcagccgtataaccggccacaaacaccttcccataagaatttacaagcccctgcatcagcatcatgctgatggagacaatggactgctggagcatggagggcacgcccactttggcaatacgctcagccgaggacatatcaaaaaaagtaaatgactttcctttggccgcctcctcattttccatttttctcaggcgggctatcaatacaaaaaaggaaaaaacagcgcacatgccctgggctataagggttgcccaggccacacccgccacacccatgttgaattgaatgacaaacagcaggtccaggacaatattggtcagggccgacaccataaggaacttaagcggcgtctggctgtctcccagtgcattgtagataccgttcagcgaattatacaaaaacaggaaaacggctcccccgaaatatatcctcagataggcaagggagtcagccataatgtccgggtctgttcccagaagggtcagcagtggtcccgcgatgatttccccgattcccataataataagtccaatcactcccagggatatgagggccgtggaaacagttatcttcatttcaagtatcttacctgccccgaagaactgggaaataaccacggtacagcccatggacagccccgccgcaatggcaacggacaaaaagaccacgggaaaggatgagccaacggctgccagggcatcctcccctacaaaacgccccaccaccatggagtccaccatgttgtagagctgctggaacagatttcccaccaccatgggcattgcaaagaaaaacagcaatttaagaggttttccctcagtcagattatttaccatatgtacattctcctactctgtgtttatattcaattgcattttcagcaatccgccgcagataatcctgctgctgcctgcgctcttcctctgtgaatcccgcaaagcaaatctcgtcccacctgcctgatatgcggtgtatttcttccagaacctgatttcccctgacggtaagacttacaaacttctgccttttattcttctcgttgatgagacgccgcaccagtcccttttcctccagctcagacagatttctggcaatcctgcccttgtccaggtcaaaatgggcgccgatgtcctcctgggtacactggttgtcctggagaaacataatgattttcccctccagaggctgcagtccaaactgctctaactccctccggataaaccaaagctcacaacgccggtatattcccgtatactgattcattccgctctccctgttatttccattgtataatacaactgttgcaacagtcaaccattatacacagcatccgccaatttgtcaacccgcggttcagccccctgcaaagtgaaacacatttttaataaaaataaaatatttcttcccgcctgattatggtatgatacatcataacagcagccccataccagaaaggaatgaaaatcatgataagacctctgaaaaaaagcccgcgccagctggaatggaaggcgttagtaaaaagggaggagcgttttataaccgcagcccggcatcaaaaggagcctctgctgaaccggaagctggagcgttttgtcccggaaaaactggaggataccctgaacctggcattttataaggcatttgagctgatattcaaccgcggaacatccatcatagaaaaaacataccggaaggaggacatggaaaatacctataaaatcaatgcttacgccgcaggactgaaggaaagcagaaagactatgaaggcattttccagggaagccggtaagaataaggtcaggaacctggccgcagccggtgccggcggaatcggcctgggagctttgggcatcggacttcccgacataccgctgtttaccggcatggtactgaaatgcatttatgaaacagccataagctacggattttcttacgatacggctgaggaacaatgttatatattaaagttgatttccaccgccctgtccagaggtgatgcggctgaatccggcaaccggagtctggacgccatgggacgcttaatccgcaccggaacgcctctgtctgaaacggccctgtctgaaatgcctctgcccggaacgttctgcggccaggacggccttgccgctcttcccggcggacccgaatcccatgatacagcctctcttcgcaccagccttatgcagcaggcgtcccatgccctttcctcagaactgctgtacatgaaatttttgcagggaatccccattgcgggcatcatagggggcgtgtatgacgctgtttatctcaaacggatcgctgattatgcggatatgaaatataagcgcagatttctggaaaaaagcaatcctgatatataggacagcatatagggcagatataggccaatataggacaaactatatgtttaatttgcaaatgtcggacatttatggtaaaatataggtaaatttcagaagaaagcggggctatcaattatgaataaggaagtattaagtttcgtcgtcgaaaaaactcacgaattaatgaatgcagcatcatgcagcaaagaggcaaaggcatccgcccagacctggctggatgcggttggaactgagaacgaggccgcggcaacaaaaacatacattgctgagctggaagcagacatcatgccggttgacggcctgattggctttgcggaatccgagatgggcgcccaggtctttggggcagacaaggccaaggaagtggcagcccatgcaaaggaaatcaaggccgcaggggcaacatactgtgattgtcctgcctgcgcagccgcagaggccattcttgaaaagaaggatgacattctcaaataagaataccggttcagacatgccgtatatcggacatatcgtatatcaggtttgcaaagcaaaaaagagtatcccccggaaatggcggatactcttttttgctttgcagcgataccggaattttaccattgactttccgacacaagtgtcgtatattaaaaacagacacaagtgtcggaaatgagcaaaatgaaaggcaggtggcaaaaacacgggcaaaaaaggagacaaaacaaaggccgccatacggaaagcggcattggctttatttgttcagaagggatttaaggatgttacaatgaaagatatctgtgaggcggcaggtcttagccggggcggattatatacgcactacgggagtaccggccaggtatttgccgacatcatagaggaacttatgtcaggccttgaaagccaggttgccaggaaaatggaacggggcctgccggcggccctcatattggacgaattattagagcgttaccagtccgagatgcttgaccggagcggttcgttaggacttgctttctatgagtattacagcggcctgccgttaacagaggacaatgccatgctgaagcagtattacagttcaaagacaatgctttgcagcctgattgaatacggcattggcaaaggcgagttcaggcaggcccatgcagacgcggttgcggatttgctgctgttctcttatcagggcgtgcggatgctgagcagtattatgcccctggacgatgataatataccaaagggcataatccgtgaaatcagagccatgttagtaaagaaaaattcatgccaggaggtgaatacggatgaagcttaaaattgcaggaagcggcggtatgtttctgattcccaaccctttttgtaaatgcccggtatgccaggaagccagaatcaaacggggccggtatgagcgcttggggcccagtctttatattgaggacattggaatgctcattgacacgccggaggacattgcagtcgcctgtgacaggcagggtatttccagaattgattatctttccatctcccacaaggatcctgaccatacgcggggcatgcgaatcgtggagccgttgggttatgactgcattgccggcaagggaacccctatacagttcatagcacttccagaggttgtagacgatatcaatgcctggaacggcgatggcctgtactactatcagaatattctgaactgcatttcaatcaacaggacaaactatgctaaaatcggttccatagaattacacctggtaaataacaaaacccatcgtggcaatatgacattttatgttatatcagacggctccaaaaaagctgtttacgcctgctgcgatgtgaagccgtttgtccccaatgacttatattatgacgcggatgttttaatcatcgggctggtttccgacgacggcatacttaaagacgggtccgctcttgattctgcaccgttcagagacgatatgttcaccttggacgagatgctggagctaaagcgcacatacaggataaagcacattgtcattacccatattgatgagtactggggtaaatcctatgcttactaccgggaatttgaaaaaaagctggacaatgtatcatttgcctatgacggcatggagattgtcctatagccgccgcaggccagaaccctttatctgcgttatgatttccccctggaccacctttttttaatctggacaaaaccccagaccaggaacagaaaacccatcaaaacagacgctattataccggcggggctcagtgaaaactcaggcccgctttttacaaacagagactgcatcacagaaaaaacattgttggagatatgtatcatcattgttattcttatgtctcctgtcagggtgaggagtgagccgagaaccagccccatacatattgcactggcaaactgcacaggattgcggtggaaaacagcgaacaagagggtcgtaataaacaccggataccaccttccatattttccgctgcagcagttaaacaggattccgcgaaataccagctcctccaggacaggcccaatcaggcccacatacaggaaatgggcaggagtcctggcactgtttaagattcggctctgttcctcagccgtcatttgtcccaatgtactctgtgcaatctggggaaataggaaaaaaaggacgcggtgtgccatacacaggccaattcctgtcatggctgaaaacaggaccatctgcaagccgttcttgagccctgcctctttttttcctgccgcatggggcaggtgggaacggaaaatccatataaaaaccacgtgtgcccccgcctgggccgcatacgtaatcccggccaggaatccgtaccctgccgaagcaaagaaagcctgaaccaggctgatcattacctgcgacaaaatcagccatgcggtaaacaccagaaataccataggaatcacctctgcccttcagtcaaatactcatttccctactcttcaaatgtccccttcataataacctctttatcccacacagccttcctgcctccggccataacatggaggatatccatggaatcatcgtacaccacaaaatccgcgtctgcgccttccgccacagtccccttgactcccgtcagtcccagcaccctggctgggttcttagtcaggaggttcagcaccttctccaggctggctccccgctcgcacaccagcaccttcagctgttgatgaaggctttttggggatgcataggtgaggccgatgcattccatcttgtcattgaacctgggcgcgcttccgtacgcatcgctggacatggtcatgttaagcccctccgggtcctgcttaaggtagctcagaatctggtccgccgtctcttctaactcctcccttgtaagccctgccgtcatatcaatggtgccgccccgcttcacaaattccagtccctgttcaaacagctcccgggtgcgtcccatatgggtgggaaggaacttctgaaccggtacatcgctgttgtcaatcgcatagaacagaggatccagcccggcctttccgcttcccatatggatagtgacatagccgcagcacccggagagcatgccggcccttcgggcctgggttgccagggaaatcagctgctcccctgtcagattggagcttctgtggtcgctcatggcgattttaactcccaccatcaggtcaattagagctatatcccgctccacgctccctgtgatggtgggggagggatatccgtatgctcctgtaaggatacggcaggtgattccctcttcattgaaagcccttgcctttgccagaaggttctccaggcttctggttataccgtctgtacccaaaagtcccaccactgtggtaatgccgtttctcaccagcacgctgaggcttgcctccggcaccctggtggcgggtccgctctcgccgcccccgcctgttatgtggacatggatatccatgtatcccggcgtcaggatgtgcccgcccaggtccaccttctccacctcctcaatctggtcgtattcatctatatggtccgctatcctggctatgcggcttccttctatcagaatatccttccttcccagatgctccggcgcatatatatctccctgtttcaatactttcatggattcatttcctctctttcagcaaaatcattacagcatgaccgtaatatatatgtgcctattatattattaatatggaaaaaaagaaagtgcctgttgacggttacaggcactttcataaaacgcaggaagatatcagtccagatgcagcaaagcttctgccagagccaatatggtcagcgactgcccataggccatgggcgcaatcaatatatttttatagtggtccgcatcatatcccatgccggtaccgcccgacacattgagtacggtgccgtccctgtcaatgttgtccagaatggcttccactgccttccaggcgcagggcaaataagaatcgtccaggattccgtagcggattcccttgagaatacccgcggtgatggcggcgctgcccgatacctcctcatagctgtccgcgtcggtcagcaccgtgtgccacaggccgcttttgccctgaagtcccttaagggcctcggcctgggctttatatgtatccaccacaaactcctttacgccggcattcatggtccccctgaacatgtcgatataatccagtatccctaaggtaaaccagctgtttcctctgcaccagaagattccgccgaaattattcctttcattgaaggtccagccgtggtagaaaagtccggtctccttgtcgcacagatatttaatatgcatcagcacctggtggatggactcgtcaatccacgcctggttctggtacttctgccccatccggttgagaaagagcactgtcatgaaaatggtgtcaatccacatctcattttcattgagccgtactccctggcggtctccgttggcgctggtcacatgctggaaccccccttccctggtcctgggcaggcagttcatgagccagtccgcccacttcaggcacagcgcttcaaattcctggtcgtgataatacccgttaagctctgccagggtgagaaggggcgtggtggtattgatgtttttggagggaagcccttcccttatgttatccttgaaccactggtacaggaactccttataatcctcgttcttccgggcctgcatgattcttaacaggccgtacagtcccacgccctggggccagtcccattcccggattccaaaatcccgtttgaaaaagccaatggcctcaccgccctcagctaactcctccccgttctccggtccgcccagattcatgagcttttcaatgacaaggtccagtttttcctgcactttctttttatctgacgtcctaagttttacactcctcattccgattccctatcctcctactttaacaatcccaggacaccgggcagccacatgctgaatccgggcacaaaggttatgaacatcaatgccgccacaatcgctataaagaacggaagcagctttttcatcacgtcctccacctgcagcctggcaacgctgcagcccacaaagagtacatttcccaccggaggtgtgatggtgccgatggacaggttcatgacaatcatgacaccgaactggatggggtccattcccaggctcttcacaatgggaaggaaaataggcgtgaaaatgagcagggccggagccatgtccatgaaggttcccacaatcagcagtgttatattgatgattaacaatatgacaatccggttatcggagattcctaaaagcaggctgctgatggcctgcggcagtcctgtgaaggacaggacaaaggacagcacagaggacgcgccgataatcagcatgacaatggtggtcataaccgccgtgtccaccagtatcttggggatgtccttaatctgaatactcttataaacaaataccgacaaaaggaaggcgtacaccactgccacgcctgaagcctcggtgggtgtgaaatagccggaaaggatgcctccaatgatgatgacaatgaggaacaggctgggaatagcctcccatatggtctttaaaatgatggccgcagtcatcttgtcccgtttcatcacatatccgtgctttgcgccgtagacgcaggccaccaccatgcacagggctgcccacaaaagtcccggcacccagcccgccatgagaagggccgcaacagagacaccgccgctggcagctgaatatacgataaaggaagcagtggggggaatcagctggcccacaggcgcagtggcaatattcacggctgctgaaaagcccttgtcgtatccctgctcttcctccagaggaagcatgacgcctccgatagctgttgccgctgcaatgcctgaaccggatatggaaccaaacatggcattgcctgctatgttggtcatggccagggaaccgggaaccctgcccagaaacagcatggccaggttaatcagccgtttggctatgccgccgctgctcatgagcagacctgccagcacaaagaagggcacggccaaaagtgtaaagctgtcaatgccgctgacaatcttctgggcagagacaaacattccaaacccgggtgtcaggaacataatgatggtcagcagtgacgctgagataatgctgaatgataccggtacgctcatggccagcatgagaaagaataccaggaccagaacaatggctgcctgaatttccatactatttttcctcctttaattcctttgtgaacgtgataagacgctgcaggcagtataacaccatcagaacgccgcttatgggtacgcagatataatatacctgcatgggcagttccatggccggtgatatctgtccggctgagttaagggtcaccataacgcctcctgctatcatcacaaagacgctgataaacaggaccaggaattcgattccgatttttgtcctggtcaggttctttggcttaaatgtcctggtaatcaggttaatggacaggtggctctccttgccgtaggcgtagggcacccccagcatggtaagccatatgagcatgtaccttaacagttcttccgtatatttgctgggattgtgcagcaggaagcgggtgattacctgccagaagcaccccactaccataagcgccaccagaatggccagcacggtttccagaaaccggttcaatattttcatcatcttgttttcccccttcttactctgcatacttctggatatcgtcatacagggccttataactctcgccctttgcacagaatttattatggatgggctgtactgcctgtatgaacgcagtcttgtctatgtctctgtaaacgtgcacaccgttggattcggcctcttccatggcctggtccatcattccgttgtaaagctgcttgaagttctcgttggtcttttcaaagccctttaccaggtagtcctgctgttccctggtcatgcggttccaggtcttggtgctgataatgtagatgtccggagagtactggtgctctgtatatgtataggacttcaccaaatcctgatggccgtccacggtaagggccagctccgtattctccgctccgtccacaattccctgctgcagtgaagcgtatgtctctcctgccgccatgggaaccggggttcctcccatggcctcaatcatatccatagaggtggtgttgggcatggaacgtatcttcttgccctttaatgcagacggttccacacagggcttgtcttccttcagatagaagttccttgcgccattggcatagtagcctatggctatgtagccctcgtcctccgtggacataaacagttctttcaccttctccgatttctgcatggcatcataataatgctgctgtccgttaaaaagatatggtacggcaaatatggagtactcctctttaaactgccccagggtgttggagctgaccttggccatgtccaggattcccgccttcaccatctcaatgatatccttttccgtcccaaggacgccgctgggataaatctgcacctccatgttcatggaggcatcctctgccacgatatctgaaatcagggcaatggaatccgctatctcggatccggccgcctggttatgggccagcctgattaccagcttatcgctggcctttgcacttgtcacctggaaaaaggtcacacatattacggctatgcttaaaagcgccgccgcgataccgattgttttcctgcaagatttcatgttctctctccttttcatacgtgattcacgctgaatttgctgctgtgcttttgtttgactagattgtatcacaggaaggaggctgtttcttattccctgttgcattcttttttaatttttcaaactatattgctctcctctgttgacatgtccgcctttatttattacaactatactatagaaagatttatgggaacaggaggatgtggccggtatatggaaaaagtgacattttacggagaaattgaggggatttccctggagcagatggtccggtacggcaaatttgacatgcgggtaaagcatttccataaccagtatgaaattttttatatcattgaaggggaacgccttttctttttcaacaacagggaatatgtggcccgctccggagacctgattctggtggacaccaacctgattcatatgacaaagtccgtcacggcagaggatacgggccacaaccgcgtcatcctgtatgtcagctatgacaggatgaaagcctttgacgaacagtacccttccctgcagctggtccggttctttcatgaacactacggagtctaccatctggacaaggagcagcaggccctgttcctcaatttctaccgcaacctgcgcattgccatgactgaaaaagcccataattacaaggtcggcattgatcttgagacccttacgtggctctttaagataacctcctatgtgtcaaagcaggagggcgccagcccccactcctcagaccatcccaaataccgcacagcctacgccatcgcagactatctctccgaaaactgcgaacagaacatatccctggaggagctggccgcacacttttatctcagtaaatattatgtctgccgcacctttaaggagattacgggatacacagtcacagagtacaccaacatacaccgcatccgcaaggccaaacgcctgctggaggagacagacatgagcatctcggagattgcccatgagctgggttatgaaagcctgacctattttgagcggatgttcaagtccttcatgactatttccccgctcaaataccgcaagaccctgaacacagtgacctataccaatgaacagaccacagaatttgaggaggacacagagcagctttcctcccaccggcagccatagattcaccacaactttgtatgattcctttcatgcatcaaaagagagagcatggcccttaacggcggaacgctccctcttttctttgtctttgtattgccttctcaatcttcctgattttctttgttcttcctatttctcatacaggaatttctcgggcaggtttacatggaaatccgctgccagatttctgaaatcctggggtgtgatggtctgaagcttgtccggacggatgctcaacacctttaccaggatttccgctgatttctcaatggtatgcatcaggccaaaggtcaaatcaaagtcctcgcccgcgcagaacaggccgtggtgggcccatacggctgcgtcgtactcttccatcagcctgctggtggccactgcaatgtcgcggccgcccggcaccatccagccaaccacgcctatgccggatgggaataccaccggacattccgtggccatttcccacagttccctggtaaatacctcgtctgtcagaggcaggacaaaggtcagcgcaatgatgtttgccggatgggcatggtaaatcaccctgtatctcccctctgttgccttcattttcacctcatggttcatcagatgggtgggcagctcgctggtgggcctgccgccctctgcgagtccccagcagatacggtagttctcccctgcctggtccacttctatgatgcagcagttggactccggttccagaatcatgttgcgcataaaccgaccgcttcccgacaccatgaaatactcccctgccagggcaggaacactggtgccgatgggctgccatttcccgtcataagaaagctcctccttcacggactccacttcctcacgtttgatgcggtagcttaaattgccgccgttcctctcatgccagttctggttaaaaccatcgtcacacacacgtatgaagccttttgcaaaggctgtgtccaatactctcattttctaatcctcactctctttctgagattcattatcctgaatttatgctgcagggataaacggccccggctcttctaatacattaaccgcgttttaagagcacttccttctcataggcctggacttccttaaaccactgctccttcaccggaacctggttcatctggcagaaatagtcccatacatccccaaagggatacgttttaagctcttcctgctccatcataagctccgtgaacctgcgctcctcctgaagctttgcaagcttctcattgggcatcagcagggcgtataaaagggccttctgcatgtttctcatgcccaccacccatgcgcagatgcggttgatgctggcgtcaaagaagtccagagccagaagcaccctgtccgggtcattcctgacgatttccttggcaatctcccttgtctcgtcgtcaaagagcaccacgtggtcgctgtcccagcgcacggggcggcttacatggagggcaatcttgtctgaaaacagcagcatggatgatatcttatcagatatcatttccgtgggatggaaatggccgctgtccagcaggcacataatacccctggaagccgcatagttcatatagaactcatgggagcccacggtacagctctccatgccgatgccgaacaccttggattccactgcgataagcaccttgctcttatcgtaatccatggccaaaatctggtccagggagtccttaagcctggccctggggctcattcggtcagccggaatatccttgaatccgtccggaatccagatattcatggcacaggggcttcccagttcctcggcaaagtactgggaaattcgcacacaggccttacagtggtcaatccagaattttctgatttcgggatcctcactggacaaagtggcgttctcagcctttggatgggagaacatggtggggttaaaatccagtcccaggcctctctccttggcaaatttcacccaatctgcaaagtgccttggttccagtgcgtctcggtccaccttttccccatcctggaaaatggcatagctggcatgaaggttgattctgtgcctgcccggaatcaggttaagcgccttgtcaatatccgccataagctcctggggattcctggcctttcccggatagtttcccgttgcctgtatgccgcctgacagactgtccgcgccctcaaagcccataacgtcatccccctgccagcagtgcatggaaacagggatatgattaagccgctccactgcggcgtccacgtcaatccctaatccggcgtaaatttcttttgctgattcatatctttcctgtatattcatggttctctccttttcatcattaaatcttacttaaatacaagtcatctgttaatccaaatgaaacaccggtacaaaatccacgcataccggactgttgtctgcattcgtttccatgatgtcggccatatagtcccaccatctgcggtttatagacgtatctgctgatttagcccagagcgcctcatcctccacttccagatacccatagagcacattggtttccctgtccagaaaaatgctgtagttatgaccgccgtactggcgtatcatctctttcatctcaggccacaacgcattgtggcgcttctcgtattcctctgccattcccggattaaggaacattttaaatcccttcctgaccatgcggtaccctcccttcgtcaaatcatttatcgtaacagcctcaacagtcaccatttagcaaaccttctcagaaggttcataggtcttgatttcaaacgagccaaaaatgctgtccctggcctccttcaggctcttaaactccttcccctctatcatctgcaccgccagattgccgatggccgtggcctccgtgggtcccgcgtaaacggtctttcctgtggcctctgccgtcaggcggtttaagtagtccgcattggctccgcctcccacgatatggatgcagtcatagcgcacgcctgtaagggcctcaatttcccggcagcagatgcggtagcagtccgccaggctgttgtaaattacagccgccatctcccacttagtctcaggaacctgctgtccgctctcctcacagtaagttttcactgctttgcacatgctttcaggagccaggaaacggctgtcattgcagtccacaatggaggaaatggtttcgcgggaagccctcttacatatctcgccaaaggaataatcctcccctgattccttccactcctttttcacggactgaatcatccacagccccatgatatttttaaggaaacggtacctgtactcatatccgccctcgtttgtaaagttggcctccatgctcatctcccggcagtcagcatccttaagctctgtccccattaaggaccaggtaccggagctgatatagagcacatggtcccggttggacggtacggcggccacggcggaaccagtgtcgtgggtggccggaagcaccacccggcaatccagtccggtctccttttgcacatcctcactgagccttcccaccacggttcccggcatggacagcccgccaaaaagcttctgcggatatcccagggcctcaatcagttccctgtcccaggtacgttcagagggattgaccagctgagtggtggtggcattggtatactcctgtttctgtaccccggtcagcaggaagtttaagtaatccggtatcataaggaaactttctgcctgtgaaaggatatccggctgtttttccttcacagccatcagttggtaaaccgtgttgaaaatctgtttctggataccggtcctccggtacagttcctccctggaaatccgttcatacacctttaaatccattccctcggtgcgcctgtccctgtagccggcagtcttgcccagcacatgtccctgtttgtccagaagtacaaagtccacagcccaggtgtcaatccccatgctttccggattgatacccagttttttacattctctcattccggccttaatttcctcaaaaagcccaacgagattccagcacaggttcccgtccaccatttccatcccattggaaaaacggtagatttcccgcagattcatcttcccattctccatccaccccaggatatggcggccgctggaggcccctatatccactgcaagataataacggttcactgtcacacctcctagttatgagcacttggcgtctgtcttttgacgcttacgtgcgatacatgtcatctccacttggtgaggtctttcacgaacctagtggagtggctcgttatgagcacttggcgtctgtcttttagacgcttacgtgcgatacatgtcactggcacttagcgaggtcttttacgagcttagtgcagtgactcattgctttcatgatataccatataaaacaaaaaaataagaacggcatttatgaaaaaatgcgtccttatttgcacataagcagaatttgaaactgaggggcattccacgcccggaacattctatccgttcttcctgtactccttgggagacataccgtaataggtcctgaatattctgtaaaagtagctggtattgtcataccccacagcaaagctcacgtccgccaccggcatgcgcgtgctgtgaaggagaaacgcggcctggttcagccgtttaatctgcagtaattccttgtaattgcggcccagcaggcggttgatggcacggctgagccagtacacatcatatcccatcaaagctgccagctctgtcaggcttccctcccggtaatgctcgtctatgtagcgcagcacctgaagggtaagctgctgctcaaaggattgttcgctgtcgcggtttacccggatccgccccgtataatgcataagatgccgcagcagcagacccatggtagtctggttcatggcctgcattccttcccgctcatgcataagggaccacaccaggttttccaccaggttctggaccggcagcacatccgcaatctggaaatgaagatagcgtccgtacctggtatcgtcgcagaggcatcccacaataaaatcccgcagcagattctcctcctcccccatcatacggaaggccgtatcaaaaaattcgggaagaatgataaaattcaccgcaatgtcatcctgacccgcaggccggatttcctggaccgcgtgctggtttaaaaacagcagttccccttccttaagcttcagctccctgccgtccaccacatggatagtatctcccctgcacatatagattacctccacatagttgtgggtgtgctccggaaaatgcacgaaacgggtatggggccggatggtaatgagctgtccggcttccagaagcttatcgctgtcaatgaccatgtcctcacgatccatatacagggtcctgtcaatatccgcactgcctgccagtattttctgttcttcttccgtaatgacgctcaggctttgaatcagctcctggttcatgtaaatctcctttctataattaaagaaaactgacgaaaagcaattttcagacacgcaacggtgctgtcattttatttacaaaatagcataacaaacggcagacgcgttggaaagcctttcatatacaaagttttctgcaatatgctcaaaactttcctcccctgccaaaggttcggaaagcttttattatagacagtcaggaacagttgcagcgcatatcatagcgaacctctctgtcccggcacgcatcagcgcctcctatattctctaatctccatttaccacatttaccggtttccctgcgagaaaagctttgagattgccggctgccatatccataatacgctgtctggcttctctgggtgcccaggatatatgcggcgtaataatacagttcttcgctttcaaaagaggattatctcccctgattggttccgtatccaccacatccaaacctgccgcaaatacctttccgctgtttaatgcctctgccaggtcttgctgatgaatcaaaggacctctggaattgttgagtaatattacgccgtctttcattttttcaatgcttttcctgttaatcatccgctccgtctccggaaaaagcgggcaatgcagggcaatgacatctgaatttcctagtaatgtatcaaggtccgtataagcggcaatggctctgccggcatcgttgggatactgatcatatgccaatatattcatgccaagagccttggctatgatccctgtcttctggccaatccggccaaatccgatgattcccatggtctttccagccagttcaattaagggataatcccaaaaacaccagtctgcatttttctcccaccggccgctcttgacagcttggtcatgatggccgatatgatggcatatctccaaaagcagggcaatggcaaactgtcccacagaatctgtgccatatgtaggtatatttgaaacaggaatccccttttccctggcatatcctacatccaccacattatatcccgtagccagcaggcacacaaaagcgatggagggacaggcattaaaaacagctctgtccagcggcactttatttgtataaaccacctgtgcatcgccaatccgtctgatgatttcttccttatcatccaccggtgtcctgtcatacacagtcaaatcgcccatagcacttattccattccaggtaagatcccccggattttctgtatagccatctaataccactatcttcatctgttgcaccctttcctcctataatgcggccgtcctgtcaagcaggctgtccgccagatgttcaaaataccccagcaaggcgtcctttatgcccggccccccgatctccttggcagcatcccccaaccgtcttaagtgagccactctatcgctatgtataaaaggcaattttaaaagaacatatgacagataaccctcctgaagcttcttaagcatctgctgcaaatacggattatcaagcagctcccctatcagccaatggtactccaattccatctgcctgcccttgtcctcgctgcctttctccaatattttaaccgtttcatcaatatgagccgacagcacctgaacagcccgttcatccaacattccaagcatctcagcctccacaacggccatgatacgaaatgactccaacacctgtatcctcttcatccgggacacacagacatggcgattacgcatccttgtcagaaaaccttcctgtgtaagtgcctgcagcgcctctctcacaggcattctggatactcctaacttttctgccacgtcttcctgggtcaattcctctcccggcttcaaatcgcccgaaagtatctgttcccgtaaaatctggaccacaaggtccttggtctgaatattctggatgcttttcatttaattcctcacttcatagttaattgagatgtctccccctccatattctagcgcctgtggcaacctctgtcaatcgccttgcttcaccacaagattacctctgattaccgttccagtatagctgccacttcatctcccacctgggatgtggttgaacttccccccatatccggtgtaagtctctttccctcccacatgattgtctccactgcatccagtatcctctgagcccatttattgtatccgaaaaactccagcatctggctggctgaccatatggcagccaggggatctgcgatattatggcctgcaatatcaggcgcagacccgtgaatcggttcaaacatggaggggaatttatgttcaggatttaaattagctcctgccgccagccccaggccccctgcaattgctgctccaagatcggtgagtatgtccccaaacaggttggaagtcaccacaatctcaaaacgctttgggtccttaaccatgaacatgctggcagcgtcaaccagatatgaatatgtcttaacatccggatactccagtcccacctctttaaatatctgatcccagaaaaccatggaatagttcagagcatttcccttgcttatgcttgtcagtgtcttccccttttccctcgccagattataggcatagcggattacacgttcacatccaatcctggaaaatacactattctgaatcactacttcattgggctttcccttatacagccaacttccgctgcctgcgtattctccctcgctgttctcccgcacaaatatcatattaatgtcttcacatttcacatccttaagcgggcagggcgctcccctgagcaataccaccggcctcagattaatatactggtcaaagcttttacgtatattcaaaagcagttcccacagagatatatggtccggtactcccggtgctcccacggcacccagatatatggcatcaaaatccttcagtatctcaatcccgttctcatccatcatccttccatgtttcagataatactcgcatccccatgggaaatgtgtgaactcaaaggaaaagcctccatccaggcatgctgtctttttaagtattttaattccctcttccagcacctccggccctattccgtctcctggtatgactgcaattttatgtactttcatgtgaattcccccaactccttcctcaaatcagattcaggctctttaaaatataaagcccgattgtcaatgtcaccgcacatccgcaggtcgtaatcataactgtattcgaggtgaggtcaccgtcataccccatatttttagccattacaaaagctccaaatgtggtggctgaacccagcatgataaaaattgcggtcagtgcctccctcctgaatcctgcggctatggcagccgggataatgataaactccaatccggccaatttgataaagctggctgacagtgccggacctatgctttttccggcccgtcccaggtcaaaaagtgcgcccattgccagcagtcccagtggtgtggccagcacggccacatcgccgattacttttaccaggacagcaggccgtgggattcctgatgccgaccaggccatgccgcatataattccccataggataggattatgcagaattcccgccagagtctttatcagaagccccctgttaattcttcccctgcccggcctcatcatttccaaaatcactactgccataatattatacagtggtacgcagccgataatcattaatggggccatacttgaatttccatatatattctgcacaaaagctattcccagtaaagccgcgctgctgcggtatgatgcctgtataaattcaccccttatctcctttttctttaggaacatggatgctgcggcggcaatgaggatactggccgtagtggccatgaaacaaaaaccgatgaatttcccgtcccagactttaaagaaatcagctcccgaaagatccctccacagaactgccggcaaagagatgttaaatacaaaatggtttatcctatctgcaaaatcacgattcaggatacctgtcatcctaaacgccattcccagcagcacaagacagaatatcggtacggtggcatttagtgcaaatataagatgttccatactactctacctgatatatggtatccatctgtgttccattccgccccataactctggctacaattctggaagtcttatgttcaatcccccgtgggattccattcattttctcagccatggccttccaatcatgtatatccgccacagggatacctgctccggtaaaacgttccagtaaatcacggcggcatgggttcacgcatatgccatactgggtcaccaaaacatccacagaagaacctggtgttgatatacaatccaccttatccacaacaatcgacatccttgcacggctgagcggtgccacgataatcgtcatcttagcacattcagctacatcagtatgtccacccgatcctcctataatataaccatttgaatctgtatgtacattgacattgaactgggtatcaatctgggtcgcacctaataccaccacgtccagagacgaggcagctgtacttttggcagtagggcttgcatactgactggctgttatctccatatggtttcgattatctctgatggattccacggctctcaaatcaaagcactgtacatcctgtattgcctcaaaacagccggcctccaacatatctacaacataacctgtaatcccgcccaggcagtagcttccctttatcccctgctttaacataatatccttcaggaagcctgccactgcaagagaagcgccgcccgcacctgtctggaatgaaaatccgttctttaacaggccagaggcttctatggcttttgccgcataatctgcaattttcagtgcaatgggatctcttggcagtctggtggttcctgatacgattcctgccggatctccgatggcatccaccttcaccacataatccacacactcctctgaaatagagcgcctggtcagtgggtaaggcacaagataatccgtgatgatgaccaccttatctgcacatgccgcgtctgcaaacgcatatcccagcgaaccgcaggccgacctgccgatagtcccggtacagtttcctctgtcatccgacgcgggagctcccagaaaagctatgtcaatatgagattggccagattcaattgcactgggcctggacccatgtgtccggaatataaccggcgttttgagaacgccctgagagacagcctttcctaccgctggccctatataatctgtttccagcgccgttaccacgccattttccatatgtcttatcagaggagcatggctgtcgtggatagagctggcattgattttcaaatttttgaatcccatgtctgcgatttcatccatcaccatattcaggacaaaatcccctcctctaaaatgatggtgaaaggatatgcacataccatccctcaatccgcaccgttcaattgcttccctcaggtctgaaactaatttactcaaaataattcaccccctttagctcagatgccgcttccagtacaagctttgccctctgcgcaatgggagcatcgatcatctttcccctcagagagatagcaccctttccctggcgcttggcttctctgatggccccaaatacctcccttgcgtagcgaatctccttgtcacttggactgaaaatacagtttacgtcctccacatggcgcggattgataactgcctttcctgtatatcccaaccctttggcgaacctggcgtcacttctgagcccctccatgtcttccacgtccgtaaacggggtatcatatgcctcaatcccggcggcccgggccgcgcataccaggcggccccgggcataaagaatttccgctccttctttcgtccgttcgcatcttaaatccgcggtcaaatcctccgctcccagataaagggcctccatccgaggcgatgcaattgctatatcataggcatgctcaatccccatagctgtttccagcagcggtatcagcttgatttttcccacatccattccgttcttctcttctgtttcagtaattttctgttccagcttcctgatgtaattcccgtcactgaccttggtgggcatgatggcagatggaccaagcggcaccatctcctcaatatcctcctcccaataaggagtatccagagcattcatccgaataatgatttcacatccgccgaaatcaagagaacgcagagccgacttcaccagaatcctggctgcatctttctggtcgggagccactgcatcttccaaatcaaatataatgctgtccgctcccagtagaccgccgttcataatcatgttgggattatttcctggtaagaatagcattgtacgtctcatatagcttcctcctttgacgccctgcgcagtgccgtctcaaccctggcccggatcgtacagtccagagcgccatggtcgttggcctgaatggatgccgcctccactcccagcgattcggttacctcacagattgtctttatgatatcatctccaaactgctggtataccgtagattgaagttctatgtgtatgccatgctctgccggttgaacaacaaccagaatatcactggattccagggtaccagccacagcatttttatgaattatcatatctctccccctttttattgttttatcttatattggatacaaaataatgttcaaaatatagttccatacatcaagacgtatggaactctttctgaatcctcccgatgacctgggccacttccttttgtgcatctgttgccaacggctggttcggcggaatcggatttcccactgaaaatccctgaaactgaaggcctgcttttacacatgctgccagattatatttctgaaaaacacggttcacttcccacatgattttctgcagtctgaatgcctcgtcccagtgttttttttcacatagttcatacagcataacactctctcttggaagcaggcaggcagggcccgccatccaaccggcccctccaagcatcatgacaaatacaggtacatgggcagatgcgctgaatatcttcaaatcgtttccaaccacgttgctcagttgaagaagtctcccggtattgccggacgcatctttataataatttatgtttgatatttgggacagtcttttcagggttgggatctcaatttcaaaacctgtaaacttaggattattatataccaccacctgacaggacactgcatctgcaatgcttgcgaaatagtcgtaaatcccgtcctggtttaaagggaagtatacgttcaggattcccaggattccatctacccccagccgttcaaattcagctgcctgaaataccgcatctctgtttgtggatgcggcaactccggcaaccacaggcactctcccggcagcggcttctaccacaattctgacgatttcccttctctgttcccagtcaagataaaagaattctccggtactgcccaagggggtaagtccatggacaccacacccaatgagatgctccaccagattgcgcagcacctgttcctttactttcccatattcatcaacgggcgatacaagatatgggaatattcctttccactgtgtaaataccatgattctccctgctctcccgctattttataaaatgtacttccctgcatattctctcataaaccttatcctttttctcattgaatttcaccttgttttgctcaaaaagattccgtccatatgtgtcaatggatacaatgagagggccgaactctctgacccggcatgtccacagagtctccggcattcccaaatccagccactgagcctgctcaatttcctccacgctgtcagctgccacaactgcgcagcctgcgggaaatacacagtgcagggctttgtattccttacacccttcttctgttcccatgcccatgcccccttttcccactaccaggcgcacgcccgtttcccggataaattccatctcaaatttctccatgcgcatgctggtggttggcccaaccgaaaccatctcataccgtccatcctccaaaggacgtatgattggaccggcatgcaggatggccccgccttccaggtccacaggaagtttcctcccgccttcgataagacgtctgtgggcaacatcgcggcaggtggtaatatgacctgtgagatatataatatcacctatatgtatatcttccagatcttctgcctttataggtgtggttaatattttcttcgccattacagagtcacccccttgtgagatatgatggtgtatttcaaatccttatcaaatataatatgtcccttcctgtgggaccagcaccccacatttactgccacgcctatcgtagatggatgtctggccgtattttcgatatgtacgcccatgacagacattttgcctgatacgccctgaggccccagcccgatttcattgatgccgtcctccagaagcttctccaacttggctgccctttcatttgaatttttagaccccagcgttctgaacaatgccttttttgacagtaacgcagccgtttccacggaagtggccaccccaacgcccaccaccaggggaggacaggcatttaatccatagcttgtcattacatccagcacgaactttgtgactccttcgtatccctgacccggcatcagtaccatggcctttcccggcagtgaacatcctcctccagccatataagaataaatctcacaggtatcacactccggaacaatctcccaaaatacggtaggggtcccctttcccacattcttacctgtgttgtattcgtcaaacgtctccacgctgttgtggcggaggggcgcatcaaaggtcgccctgacagttgcttccttaagtagtgattcaacaaaatcaataagcgggaacctggtaccacatttcaccagatactgcagaactcctgtatcctgacagcagggacggtccagctgtgccgccagttcctgatttctgaacatggtgtcatatatggtcttgggaagctcatctgtctccagtaccctgagttccttcagcttttccgtcacatcatcgggcagtactttcccgctgtatcccacgaatttcgccataatatccgtcatatattccacggcctctgtctttgtcatcatttccatccctcctttcatgcctgttctaccttcatataatctttgacactgtcaataatcggagccatgcactcctccttgcgggaagcgtaatatttcttgttgtccacgaacatgttatttccctctgtgtcaatggatacaatgagaggaccaaattccttgattttcattacccacagacattcaggcatccccagttcccgccagtacacattttttatttcttccacatgggctgccgccgatacggcgcagccccccggatatacacagtgaattgctccatactctttacatgccgcagaggtcttttcacccattccgccctttcccacctggattttcactcctgtaaggcggataaaatccgccgcgtccgcctccattcggatggaagaggtagggccaatggaaatcatggtattcttccccggttcttcccttataataggtcccgcatgcatgatggcgccgccggcaaaatcatagggacaggtaagtccctcatgaaccactcggtgatgtacatcgtcacgccctgtgaccagttcccccgacagatagataatatccccaactctcaaatctttaatatcctcggttgtaaccggtgtcgttaaaatctttttcatagcgttacccccttatatgtcggcatctcataagacaagtcattgtggaaccggatcacgccccgacggtgggcataacatgccacattcacaccaatggcaatggtagccgtatggcgggcggatgattctatatgcacctccatggcagcacaatttcccctcaggccctgggctcctattcccagcttgttaagtccttccagcaaatcctgctccagctgtgctccctttggatgaggatggcttgtaccaagaggcctcagatatgcttttttagacaggagggctgcattctcggcattatgtcccaatcccacgcccacaatcagaggcggacatgcattgattcccaaatcagacaccgcgtcaaatacataccggatgattgccgcatatccgtcagaaggcttaaacacctgcgaacgtcccggcaggcagcagccgccgcctgcgaaatacgttatgatttccaggtcatcattatccggcacaatatcccagttaatccatggcattctctcgccggtattgtcgttggtattcctctcttcaaaataattcactgtgttctgccgcagaggtgcgctgtaggtagcattgtgggtggcctctctcagacagtccgctaccatgccctgataggcgaatcccgttcccatcttaatataaaagtgaaggagtcccgtatcctgacagcagggccggctaagcttacctgccatatccaggttttcaaaatacgcgttgtagatgaccttctggatatcgctgtcttctttctctccgcactcctttaattttgcgtacacatcatcaggaagccgcttgctgctcattccgatgaatttctccatgatgtccgtgaacctttgttttgcatcttcgtgtgtcataattctatacctcgctctgttttatcctaataagttaaccagggtcatactgattggctctatatatgtgattgccagcagagatataatcagtgcaatcagatagggcataatagcctttaccaacgcttcaaatttaatgtccgcgatattacatgccacgtacagacagttgcctaccggaggtgtaatcatgccgattgccatattcactataaatacgattcccaccatatacggactcacccccacactggtcagaaccggaaggagaatcggtgtcaaaagggcgattgctgctgatgaattgaggaaacacccggcaatcaggaccacgatattaaacaggaacagcagaacgtatttatttgtagtaaaggacaggagggatgccgctatgacctggggtatccttgccatggttagtacatacccaaaagtggataccgtggccataatcagcatgataaccgaggccgccacggctgaattacacaccacttttggtatatcccgccacttaagttccttatatacaaataatcctaccaccatcccatatacggctgccacggctcctgcctctgtgggagtaaatatgccgctgtatattcctcccagaataatgacaggcatgataagggcccacatgctgtccaggcatatatgcagaacctctttagggcttttcttttcctttattacaggaacattatgcttcttcgcatacaggtaagctaccaccatcattgtcagtcccatcagaaggcccggtcccacgccggccagaaacagtgtgctcactgatgtgttggccagaacacagtatgtaaccatgggaatgctgggtggaattacctgccccactgttcccgctgccgccacagtagccgctgcaaaggtcttttcatagccgctgtccttcatttcgggaaccatgattcctcctatggcagctgtggtagccggacatgagccggatatggctgcaaagaacatagatgcccctatggccaccatggccaggccgcctgtaatacggctgaatagtaaattaacaaatgtaaccagtttcttggatatcccgccttctcccatcatgtttcctgccaggataaaaaaagggattgccataagcggaaaggagttaattccattaaacatggactgggccgtcacgatcaaagacgagttcagacctgccacaatcgcaatcaccgccgcaagtccaagagccacagcgatgggaacccccagaaacataagtacaaaaaaacttccaaacaataatcctgtcatgaggcctcctcccccctttttttcttcagcacttcaaagatatgcaaaaaatagcttgctgccattccaaaacatcccagcatcattcccagatagacaaaagccattggaatcttgagcgcgggcgatgtctgggcactaagtttatcccattgggcacagcagtaaaacaataccaagataaaaaatccaatggatatcagatcacagagcactttcatacccgccttgatggattcgggaaacaggttttgaatcagttctacccctatatgctgtcccttccttgcccccacataccccgctatgaaggtcatccagatgaacataaacctggcgccttcctcagaccaggcaaggggggatttaaatacatacctggccagtacctgagcaaatatgaaaagtgtcattcctcccagtatcaatgcagagaacacctccatgaacttatccactatatggatcactctgagcacacaattgcccatgaaatcacactcctcctattttgttgcttcctggattttctctatcagagcaccgtactggtctttgaatgtctcatataccggctggacagctgccttgaaatcactcatatcctccactacgttcacattgacacctgcatccttaatctgctgaagttcctggtccgcactgtctatggccagctgtctctggtattctgctgcctcctgggctgcttccaataatgtggtctggtcttcctcactgaaggaattaaacttatccaggctcatgattaacggctctgccgtgaagatatgatgggtcacagaatagtagtcatttacctcgttatatttgttattgacaaaaatggcggacggattctcctgtccgtcaactgtcttcagctgcatggctgtaaaaacctcagatatggccatgggggtgggcactcctcccagcgtctcaaatgtctttaagaatacctggctctccgggacacgtattttcagtccctttaaatcctcaggtgcggttataggtttaaccgaattgctgatatccctaaaaccgttatacatccagcacaaaatcttaaaacccttggcctcggccgctgctctcagttcattacccacatctccgtccagtaccgaaaatgcctggtccgcattctcaaacaggaaaggaagattcagaactcctatctcaggtataaagttctcagcagccatggtggactccagagctatatccagggtacccatctgtacaaattctattgcctttgcaccagatgcaatctgggaagcagggtatacctccactgcaatccggccgcctgttttctctgaaaccagctctgcaaaccgttcggaaccatattggtagggatgggtggtagcacccacatggttcagtgataatgtaacctctgccttacctgccggcgcttcttccttctcctgtgattcggccggcgctgctgcttctgcctgtttcgtcccctctgaagctgctgttgtctgcggtgccgtctgtcccccacatgctgtcagacctgctgccatggctgctgctaaaatcagacttactaagtgctttcccttcttcattgtttttcctccttagttatacattaatagccccataaactggatacactttgtaaatatatgttatatgatataatgtatccaatatttatgtataaattatattagtattatgcacaaatgtcaataccatttatcgcttttatgcagcaaacctcacaatttcctgttattcttcatacttagacaatgtgtctctgaggcttcgcatcatatgagcatgcatcttctgccttgcatcctgcttatttctcatctgtatcgccttcacaatctccttgtgctccccaaatgatacgagggcattatccttaaggctggtatttctggccagggaattggatataaaaagtgtcttcaggattccttccatcctttcattatcagccagaatccagattgcttcatgtaactcataatttgcatcagcgtaatcctgataacgctcctcctctatgacctgttccatcctttttaaatggccgagcagaacagtcatgtcctttgcatcgcaggccatggcagctgcctcgctttccagtatcgctctggtcacatagtaatcagtgacatatttgcggtcgattcccaccacaacagcctccttatgaggcatcaattggaccaaaccttccctttccaaactctgcagagcctctctgattggagtgacagagactcccaggcgggctgacaaatcgcttaaaaccagtctctctcctgcctttagctcacttgtaagtattgcctccctgagggaattgaccacctgctccctggcagaccacattttaatcggactaatatttttcatatataatgtatgcagttttccctgcatacctcctttcagcttcttttacgactctttttattttgtatccattatcacataattatatcagctatacacggataacgcaatgtatttactcccctcccccagcggaaccgtctctgtttattttaagaaactcctccatctcctccatggacaagggcttggaataatagtatccctgtatctgttccactcctatatcctcaaccagctgtctctggctttccgtttccacgccctcggcaatcacggtcattcccaggtccctgaaggcatgcaccagatgtcttatggtcagggccgaggtgggattatctatggacgcccataccaggcttttatccagtttaatggttccaaacgggatgcggatcaccgtggcaatattggagtagcctgtcccaaagtcatccagtcccatttcaatcccatgttttctcatctccaaggcaaaatccgttaccacctgcgggttctctgccagtgtactctctgtaaactcgattttaacggcggacataggcgtaccgtttcgctgtataatctccagcactttccgggacaaatccggctgggaaaactggatggcggaaaagttcacatggatggcctccatgggcagtcctttttcaatcagccggttaatatatttacagacttcatccagtattacatacgtgagttcaataataaggcctgtctcctccgcaatgggtatgaattcatttggatagaccggacctatggaggtatgattcatgcgcatcagggactccgcatacaggaactgccctgttcccacggagtaaatgggctggtaatacatctccacgctgtgattggaaagctgtcctttcagaatcctgatgattttcttcctccgctccagcttttccagcatctcctggtcacaataacaaacctgtccatacctgccagtcttggcctgggataccgcgtattcgatataactgaccgcttcctccaaagtcttcacatactccgagcgccgtataattcccatcactaccggaagcttgaactggtaatcctggttctgccacggctgtctcatccgggcctctatgtctaggacgcactgccggacgcgttcccctctgtcattgataaacaaaagcgcaaactcgtccccgctgtaccggtagacattttccttgggacccacactgcacaaaaaggcgcatacctgctttaaaaaagcatctcctctgtgctgtccgcagatattattaatctgtctgaaatcacgtatggaaaccactaacagcgtgaaatccttatccggataccttctcagaagaaggtccagcatgttaaggagttcctgacggttgggtacattggtgagatagtccagggatatctgacggttctggagatgcaggtaaataatcagcaatgcacaggtggcagcggaaccggacaatatgatattggggtacatctgctggaaaaatattacaagaacagccaaaacaggaaatgtggccaatatgtgataaatatggcggtctatggagcgtctgttcctgaccgcaatgacaatgcagcacgcgcagtacgcataaaaaataagataggttataaaaatcaggctgccctgctcatagccctgatttgcagtgatatcaaacagacattttgtgaaaaaattggacagtaccagcaatgtatagacagcccccggaattccgcctaacagaatcatgcggttaagctggggcctttcttcatatataacggaaaccgcataaagataatacaccatccccataagaggcgtcagtataaagtatatggtggtgattgcccatgtaacccagacaggcacaaggatataaccgctcagcataaaggtggacagtatattgctcagcatggccgcaaaggtaacagtcagacactcctggaacatcctgtttttcagacttggcagatgactgcctttcctggaatacacccatatgattcccagaataaccaatgatattgtttccggagctatgttccatctcacccttatgtacctgccgtttcccacccctgcccgccgtacaaaaacccctttttaatctttttctcaacgtgtacaaggtgtcatcatttcttaatcatataccaaatttctgtttacatcaataaccaatatgggaaatattttaccgcaatatttcacctccgcaattcttattccgctcccgccaaaaggcgcaaaaaaattcccggcccatattggcgccgggaatttttagtcaatacaatttcaaatatttctgctctgtatccttccttcattgtggccttaaaattcataaggcgggttgccggaaaaatcagcaatcacaccgtggggattctccaggtaaaaaacaacaaaaatgggattgtcggctgtattatactggcctttcacaatcgaattggccatgcaggcttcctttacctccatattatcttcaaaaaccgcccttccatggagacgaagccacgcataagcgggatcagaaacagatacttccacctccggattagcctgcatgtccttgtacacatccttctggttgttggtacagaaccacagctttccatccttctcaaaacagaacataaagggacggcactttgctttcccatccctgcctattgtccccagatactgcaccggatttgcctgtaaaaaatccacaactttattcatcataattcccatccttccttttacttatttcttataccagtattataaaatgcgcactgctcacccacaagaacgcacttttaagtgggataggcacctggtagtgctatagtatctcaaagatactgtttgctttacaattattttaaggtattctaatattttttgttgaaaaatcccagtaactctgttacaatcccattaagaagatcttatcttaaccaatcatttaggagggtattatggaacaaatgttattcttagtcccagtagtggggctgcttggactcctgtttgccgtcattctaagacagcaggtcgtcaaggaggatccaggcactgacaagatgcgtgagattgctgacgcaatcgcagagggcgccaatgcatttctggcttctgagtaccgcatactggtcgtttttgtagctgtgttattctttgtcatcggtttcggaacacggaactggattacagccggatgtttccttgtgggaagcggattttccaccatggccggttatctgggcatgaacgctgccatccgcgccaacagccgtaccgctaatgctgcccgtacgtccggcatgcaccgcgcactggcccttgcattctccggcggaagcgttatgggaatggccgtggtaggcttaggcctgctgggcgtaggtgttctctacatacttacaagagacgtatccgttttatcaggcttcagcctgggcgcttcttccatcgcactttttgcccgtgtgggcggaggcatttacaccaaggcagctgacgttggcgctgacctggtaggcaaggtagaggccggcatccccgaggacgatccccgtaacccagctgttatcgcagacaacgtaggcgacaatgtaggcgatgtggccggtatgggtgccgatctgtttgaatcctatgtgggttccctgatttcagctctgacactggggctggtgttctatcaggaagctggcatcgtttttccgctggtgctgtcagcatgcggtatcattgccgcaatcataggctccctgttagtcaaaagcatcggcaattccgatccgcacaaggcattaaaaacaggcgagtacagcgcaaccgctttggtagtggtctgcgcccttatcctcagccgcatatttttcggcaatttcatggcagcctttaccatcattacaggtttattggtaggcgtgctgattggagctgtcactgagatatatacatccggcgattaccgttttgtcaaaaagattgccgagcagtctgaaaccggctccgccaccaccattatcagcggccttgcagtgggaatgcagtcaaccgcagttcccatcctgctggtatgtgtgggcgttctgatttccaacaaacttatggggctttacggaattgccctggcagccgtaggcatgctgtccaccaccggaatcaccgtagccattgacgcttacggtcccatcgctgacaatgcaggcggaatcgccgagatggccggtctggacaaaaacgtcagggatataactgacaagctggactctgttggcaatacaaccgctgccatcggcaaagggtttgccatcggctctgctgcccttacagctctggccctgtttgtttcctatgctgaggcagtaaagctcaccaccattgacatccttaacgcgcatgtcattgtaggacttttcatcggcggaatgctgacattcctcttctctgccatgaccatggaatccgtatccaaggccgcccatcagatgattgaggaggtacgccgccagttcagggaaaaacccggtattctcaagggaactgaccgtcctgactacgcttcctgcgtatccatttctaccaaagccgctcttcgcgagatgttcctgccaggtctgatggcagtgctggcacctctggcaaccggtctcatcctgggaccatctgctcttggcggacttctgaccggcgctctggtaaccggtgtattaatggccatcttcatgtccaactccggcggcgcatgggataacgcaaagaagtacatcgaggaaggacatcacggaggcaaaggcagtgattcccacaaggccgctgtagttggagataccgtaggcgatcccttcaaagatacctcaggtccttccatcaacattcttattaagctgatgacgattgtgtctctggtgtttgctcctctgttcctgcagtttggaggattaatctaataattaaatatcacccttacaaaaagggctccggatgttccggagtcccttttttcacaatttcacaattttcttaccgctccttatactctgacgtactctccctaacaatcaatctgggctggaacaaaatgctcttctcggcgcaattcccgctgttgataccatcaatcagctgtttcactgcctcaacccccatctcatacacaggctgctccactgatgtcagaggcacatccagtatctccgaaaaaaagatattatcataccccaccagggatatatcctccggcaccgacttgcccaggcgtttcagacggttatataccccataggcacacatatcgttgaatgcaaatatagctgatacatccttatccaccaggtaatccgcaccgtttataccgctctccctgtcataattgccgtggtataaaagggagggttcaaaatcaatttcatattccgccaaagccttcttataccccgtaagacgtgccatagaatcctccaacacatccggtcctgtaacgcatccaattcgtctgtgccccagcttcaaaagatgttccgtggccatgtatccgcccagttcatgattcaggctcacgaaacagcacctggctccttccagaaaacggtcaatcatgacaaaaggaatcttaagcttttccatcagaccaatgctttccatccccttctttttactgctgtcaagagccatacagaaaaggataccatctacgcccttatcggccaggacctgtatgtaggatatatcccgcgaatgtttgtcattggtattgcagagaatcagattccagtcctgtctgcggcattcatcctccactcctttagccagattggaaaaaaatacattgctcacatctgatatgattagccctattgtattggtcctcttttttaccaaacccacggctacctgatttggatgataattcagcctatccgctgcttccagaatgacatcctttgtctgttttggaatcttctttgcttttccatttaaaaccagggaaatggttgtcaccgaaaaacccgtatatcttgcgatgtcttttatcgttgtcctcaatgttccatgcctcattaattctatattcttatctctgattatacgatatttcaatcattttcaaaagacgtaaaaaagacttttttcataatataaacatattttgaatatttttccagctctacatactcgttgggtttatggcacagagacggttcacctggtcctaataacagaaccggcatactgtggttatattccgtcaaaatggacgcatcagtaaaatagttaatgcctactctctgtgtactcagacccatctgttttagtacctcatcaaattccgccacccatgggtggcttccttctatctcaatggccctgcgttggttcaccacattataatgatatcctcccctgcccggacaccttttaaaacgccgcgagcatacatcctccagcatcttcaccacatcctctggctccatccccggaacggtacgcacgtccataaatatttcagccctgtcaggtgtcatattaggtgcaatgccaccctgtatttttgttacctgcactgtggctgttcccaatataccatgactgtgtgaacctattttttctttaaactcccttgcaatgtccatgccatattctactgcattgatgccttcatccggataggccccatggctggtcactccgtccaccgtcaattcaatccacatacatcctttttgagccacgcccggtttcagtcctgttggttcgcctataagaaggagtgacggctgcggcatccggttttcctgcaggattttcctggcccccagtcctcctttttcctcatcacatgtccccataaaacacagattcattctgggactgcagccggccttaaccatggttcccagtacatagaccattgctgccagaccgctcttcatatcactggcacctcttgcataaaagcggttattcttcctgacacaccgttcaggaggtgtgtcccactcctcacgtttcccatagggaactgtgtcgagatgaccgtttaacaccactaaatcctctgattctccctttatgttggcaatcacatccgcatggctgtcgtcaatgggaatcacctggctgtccacaccgcagtctctcaggaaatcacagagaaacctggccactgccccctcgtcatctgctccatttacacttggtatttccaaaactgcctgtaaaaatccatattcatcatattccttcatctgcaatcacctttcttttatagaaacaatgaggcgccgcaaacatgcggtgcctcacactacactacttcgttgtcagccagtcagcaattccctgccagattttatcataatattcccactcgcagaactcaggcggagcccagtgaggcgcgcagtctgtagtgaatacagcgctcctccccttgccataggaaccaaatgccaccagcggatctccttccacttccaccgccactacagcgtcttcccttggaatggttctgttatagcccaatacctccggccagtcctccggtatgcctgaaagtgcttcatgttccctgaccacatggggctttactccttcgcagtgctccatacggtcatccacagtcagcacctctactggcaacacctcctgaaccgcggtatcatgccatttaccctttgcgtctacaccggaaaaagtgagataaccgcctaccatgataaggcttcccccttccagtacataatcccggatcagctttgcccggttaggcatcttttggctcctggtaaaagtggggaccggaagcagcagcgtgttggctcctatatctgagagaattacacagtcatacttcttaatttcttccatagtaaatggaaattcttccgaagccagatgattcggcagaaaatccacctggtatccccccttctcaagagctgctttcagccatttttctcctgtctcatatacggatgtataaaaactgtcaaatcccttcacatgggtggtataactcatccatgattctcccgcaagtaatactcgtttcattttcatctacccttccttttctattctctatttttctcgacccggataacaaacttattcatcatatggtttagtatgatagccagaatcagaataaggcccaggactgccagctgccatacggaatttatattagcaatctgtaatccggaattcatcatggtgatgatgatgacaccaatcagaacaccgcccagatgtccgctgccgccggccacgctgataccgcccaatacagccacagttatggcctgcatctccattcccgtaccagcatccgccctggccgtcataagccatgaattattgatgacagcactgatggcagccagaacgccggccagtatatatattcccatccgaatccttacttcacggattcctgtgaacttggctgcctcaggatttgtccccataagataagcacgccggccaaacttcatcttgtaaatcaatatgaataccaatatggtgaccggaatcaccacaaacagtatctgattaggtatcccaaatgtacttttaagtgagagccactcaaaggattccggaaatccgctgatgggtattccgccggtcagatataatgccagcgagctgtacacatactgggtacccagggtggcaatcagcgccggcacacccgccatggctataagcacaccgttgacagcgcccagggcagcgcctgctgccaatgaaatcacaatagccaccggtatacttgccccacccataactgccaggccaaatataacacctgaaaggctcatggtggaaccgatggagatatcaataccgtcctttcctccaaccattaccagggcttctcccagtgacagcagggtcagacctgctccgaactgggtaatctgtaatagattgctcagactcagaaaatatgggctgatacaggagaggaccacaatctccagtgccagaagcagaagaaggaattttgttctgctctttgcgattgaaaatgctaatttactcatgcagcttcccccttcccctttaaaagcccgtatctggatgtcaatgcatcaaacaatacggagatgatgattagaagtcctataaagcaattctccagcagtgaaggaattccaagaattactataccgtttttgaggaatgcgataaatagtacccctgcaagcgtccctatgacactgcctctttttccgcctcccttggagccggtaccgccgatggtcactgcggcaatacatgcaatgggaagatctgaaccaatagtcatctctacactccccattctggctatgtaaagcatagctgctatcgcaacaatgccaccggatatacagtaagataccatcttaacacctgcgatattaatgccgctcaaattggcagactgaggattacacccagtcgcataaatatgccggccaaatctgcgatacataaggaaataataaaaaacagcatagacaccgatgatgaaaagcaggagcaccggaattcccagtactctggcacgggtgataactccataactgggattcagacccgtaagccatttgcctcccagcagtgcaaatatagctgctttccagatattcatagttgccagtgtaacaatcatatccggtatattaaactttgccaccaaaaaaccgttgaccaggcccagtccaatgccgatacagatagccacaaccgcaatcaaaagaatgtttatatctgcctgaagcatgtatcctatgacaatggcgataactcccatgacagaccccaccgacaggtcgattccgcccaacagcatgacaatggtcatgccgatacttacaatggcaatctctgcattattctgtaccacacggaccagattggatacagtcagaaaattaggagcaaagatgccgaacagaacgatttccagaaacaggagcaaaaatgttatatattccctgcgccccggctttggaacgtattttttaaacatatgtttacctccatccacataatctgcgaagacgatagcgtggcccttctgacctcatcacgccacaccgcaccagtccattaaaatagaggcaatcatcttggtgcaggttacgagttcatcaacttccacatactcgtccgcctgatgggcaagtctggaatctccgggtccaatattcatggtaggaatacccacattgcagaaccatcccatatcagtatggcagcagatgccttctacctctgaacctggatttatctctctggcgctgtcccttacggtctggaagaatggctggtcatccagcgtttccccacagtcagcatctatgagccactcaattctgggaggattttctcttaaccacggatctgtcatggcaactgcctggacaaaatcctccagctccttctttaccctggagcccagtccgttctcatccttctctgccggcagatactgagcgtcaaataccaattccgcatgattagcaaatgtagtggggtactcccctgcattaaactgggcaacatgaagctggcatggaataggcaggtacttatgttccttggtcacggaccactccttgttgagcctcctgaaatgttccaggtaaagggatgccttatcaatggcgtccactgcccctccggttctgtaatctccctgtttcagttcaatgtgtcctgaccttccctcaatgattaattttccccaaaggattcctctgcaaagaggcgcaatcttcaggtgggtgggttccgtaatcagacagccgtctgccctgtatccttcagccaccagtgccagggtacccattccgccggcctcctcgtccaccacggttcctatcattgcatcgcccttcagctttatcccgcttcggctaatagcttttagggctaccgtcatggccgcaataccacccttcatgtcaagggctcccctgccatatatttttccatccactatctccgctccaaagggatcatgtacccatttatttcctctctgtaccacatccatgtggcctgagagcagaatggatcttcctccgccttcccctttcaatgtccccagcagatttggcctgtcttcaaaggtatggtccgcataataacctgccttatccttatacgccaccagtttcccggcatccgggtaggtaagctccgtgtccatccccatatcttccaaatattctttcagatatgcctgggccttcccctcctgcatgtactgcttatcctcatcgaaatacggattgacgcttggtatccgtatcagttcctgcagcagctttacaacctccccctcattttcatctatccaccgatatactttctctttcatttattaaacctcctcgctatgaacacttaaagactggtctgacagattcagcgcatttttcagaatcttctcttccgttactgtttccctgtcaaactcggccgtgatggttcctttgtgcagggtcaggatacggtcgcttacccccattatttcaggcaggtctgatgatattaccagtatggccacaccttccgccgccagttccatgatatatttatgtatctccgccttagtggccacatcaattcctctagtcggttcatccaatatgaggacttttggttttctcataagccaccggcacagcagcaccttctgctggcctcctccgctcaggctgttgacactcaggtcctgggagggtgtcttgatgctgtatttttctatattatcctgtactgcttttctctcttccttcttacggataaagctgaatttattagagaagccgtccaaaaaagatacgctcatattgtccctgatagggtgaatatcaaagagcccctgggctcctctgtcctccggcacataaaatatattcttttctatggcaccattaatatccgttcctgtaatatccttcccctcaaaaatgatgtttcctgtttcggcctttgtctccccgaatatggccctggctatctcagagcggcccgatccaaccaagccgtacatccccaggatttcaccgggtttcaatgaaaatgtaatattctggtattgattcttataccccagatttctgacttccagtattatatcgtctttaatctctcgggtctggtatacgctcatattgattttacggcctgacatggccgtgatgatagattcttcgtctgcttccctgggagacagggtgcctgtcagacagccatccctgagtacaataatattatctgaaattcgcagtatctcaggaatcctgtgactgatatacatgatgctgacccctttggacttaaggtctgcaatgatttcaaacagtttctcagactctccatggctcagtatggaggtcggctcatccagtatcagaatcttacacttcttataaattcctctggctatcagaaccagctgctggtttccaatagacaattcgctcattgtcagatgaagaatattgccgttaagccccaccaatttaagggcttccactgcctcctcgtacatttttgtccactgaattgtcttgtttaaatttaccacttcattacccatgaagatgttctccaaaacagacatatccgcaaatatattgggttcctgatatacaatggatattcccgtcttaacggcatctaatggagaattcagactcagcttttttccttcaaaataaatctctcctttgtcattcttaagggccccggccacaattttcattaaagtggatttaccggcaccgttttcgccgattacagagagtatctctccctttttcaattcaaagctaacattctgcagcgcctttacaccgccaaatgacttgctgatggattccgccttcaggatgatttcttccgccaattatctcagctcccttctaaaaagcagggcacacatcctccttgtgccgtctgaatgcgcgccctgtctgatgccttacttaatacgctctatattttcactcgcaacgttagaaatcaaagtcatttacattatccttgtcaataataagaggctggcctaaaagaagaatcttattttctgcgtcccatgtaaccgggtctgcaataccttcaatctgattagtcgcctcaaattccttgccctctgctgccatcttgcctgcccatacagtcagatatcctaaatcatatgcattccagagaacagactgcttcataacgccggattcgatgaacggtttaactgtggctggtgaaccataaccaattactgcaacctctcctgccttgccttcctgttgtactgcctgagcaacacctggtatagttgaggatgccactgcaaccagtcccttaaggtcagggtaacgtgtcatcagctcctgggcctgctttaatgcctgttcactgcttccgccctgtgtataacggatgtccacaatctcaatatcaggatacttctcttcctggcgctgtttaatatagtcaatccaagtgttcagattagttgccgtggattcgccggatacaattccaacctttccgctgccgcccatctgctctccaagacagtccatcaaagtagtacccaagtccttatccaatgcctgcgccacatagaaatctctggtactgtcaggagcatccgagtcactggtataaaccttaattccggcttcctgcgctttctttatgtatgggttggtggaagaactgtctaacacggacaatgaaatcgcatttaccccctgcttaatcagactgtccataattttaacctgctctgccgcacttgcctgagttgatcctgtatacaggaattccactcccaggtcctctgctgccttcttaccgccgctctccatggcagagaaataaggaataccgatcagctggggaataaatgcaatcttcactttatcgcctgtgccctcttctgtttttgcagcttctgtgcttcctgccggttcctctgccttggtgtcctctgccttggcttcagccgccgttgttcctgtcggcgctgactgccctccggagcagccggccagggaacctgctgtcatagctgccgccaataacaatgctacatgcttactcatttttttcttcatttttcttcctccttaaaaaaattgtatttggtaaaacgtttttccacgaaaagtaaaaaaaaataatatctcttattttttctttttgtgtttaaactaataatactttattatgtatatattgtcaagtattgttttggtttttttgttttatttgtgtattaattccatgtttgctaatatgcatttccttacccgtatgccatatggcgtaattctcttcagcaaataagaaaaccgtttttccaaagattatttactatatattatttaattatcttttcatttaaaaaaaatactcataaaagactgattattccccctccccatgcactaacctgctgtttttattcaaaaaagcgaaggaggcttccgctcccggcgaaaacctccctcaatctatttccatcactcatcaaaaatactcgcatttcccctgttcaatattacctgaacgcatccaggcacattgtcatcaccttcttttaaaagctcctgtatcctgccccagcaatccccgacacaatctcatccgccagcccgtccagggccttcactacctcgtctatttgctccggcttcatattgtcaatatggaagcctccggtgcacaccactacccggccggtttccctgcacagtttctccgccagcctccggcacagggcctcgtccttgtggcctgtcaggttcagtatggaagatgttgcgcttatggttccgtttcctgtcagggacggccttggcactgcctggaccgtacatccgatatggggcttgtctcctccctggatacaggccaggatatcctctcctaaaaaagcagcgcctgcctccatataggaacaggacagttcctttcgtccccttataatccagtccatctgcggtactcctttccctcgattccaaacggctccagcagcttggaagcaatatgatatatcatctcctccatattctccggcctgtggtaaaaggtcatcataggaggaatcactctcactccgggcatcatggacagctcgtacatattcctcaggtgtatggggcttaagggagtctccctggctgccaggaccagagtccgctgctccttgatggtcacatccgctgcccgcagaatcagattttcagcataccctccatggattccggcaatggtcttcatactgcagggcacaatcagcatcccttccgtggcaaaggatccgctggcaggcccggctccaatctcatccgggcccaggacatgatcagccagcccttccacctgctccgcagacaggtccgtctcctggcctaatgtaagaacagcgctgtggctcataatgagataggactcatattccggctgttcccctattaactccagacattttaccaggatgggcagcccgctggcgcctgtagcccctactataatcctcttcccccctctgttatgtcctttgcttttcatgaaatcttcccctcattttcctgctttacccattcggacgggtccaattccatgaatctggcccgtacaaagcggtccttctggtcaaatgggaccgtacagtcaaaaatagtcttacaagcaatgccatggtctcttatgctcggtgaaaatgccgggtcattggacgggtccagaggatggcatctcacccccggaatggttatggtatccacatctccctggaaccttgtgttcatggcccatagcacatcgttcatatcaaaacagtccacgtcctcatctaccaggaaaatatgcttcaattcactgaaagcggaaaaggccagaagggctgcctgtctctgcctgccttcatcactggcaacagacttcttaaactgaagcaccgccatgtattttccgcctccggcagaacagcagtatacattttgaagccggcccggcatggctttttccaccataccgtatatgctggcctctgtggggattccggccatggacacgtgttcctcgctgggcccgatgcaggtctgcataatgggatgcaccctgtgggtaaccgctttgaccttaatgagccagcactggtcgctggccggccctgtatatccgggaaattccggcatggcaaagcctgtatgggtgttctggtcctccttgattctcacattgggaaccacctcaccctcaatgacgtactccgcattggctatggccagttcatccacggtcaggcaccggcacagtttgaccggctctccccgaagcgcacctgccaccgacagctcgtcataccccaatggcgtggtgggcggttcaaagcaggaaccaatctcaatggccggatccactccgatgctgatggagatgggcagcctgcggcccagctgctccgccctctccgccatggctccgatatgtctggcacctggcgtaaagaaaatggacagctcatccctgccctggatacagagcctgtggatagtcacatcatgggcccctgtatccggatgggcggcatagcacatgcccagagtaatatatgggccggcgtcataaggcgtgttggttggcgcaggaaccagcttatacaggtcaaaatccggctcatcagccctgtgcaccacctgctggcagaccggttccccctggcacatcacaggtaaaaccggcttctccacactgcggcagagcatctttcccagctcctccggcttacagtccaaaagggcagccacacgcttcctgctggccagcacgccgatggcaacactggcatcgggatgtcccttcacattgtgaaaaatcatggccgggccttccttggtaggccgctttaccgtacctcccgctcccacataccggtaaaccccggataattgggccattggctcaacctccacgtctgtttccagcagctgccccggcagctctgccaataattccagcgcacttctcaaatccctgaccttttttgccatatcataatctcctgtccggcgtttcttaccatacgcctgttatcatttcttctatctcacatcttaacggaaaaggactggagaatcaattcatcttatggtataattgtttccaaattggaatgtattcacaaagcaaaccggaacatataaagaacaggcatgaatctgaatatgccctctcatatgtcccagaaagaaacggatgacagatatgacctttgaacaactggattattttattgcggccgtccagtgcgacacctttttggacgccgcggagacacttcacatcagccagtccgccctgtccaaacaaatcatgaagctggaaaaggaactggatatccaactgtgggacagaagccggcgctccgccgtcctgacagaggcagggcacatgttctacgaggaagccctgaacctgtccaaagaataccgcagaaccctctttcgaatcagcgaattcaaggaaaaagcaggccagaggctgtccatcggcaccctccccatcctgtcccagtaccatctcacagccatgctgaaggattttgcagacagccatcccctcatccatgtttttctggaggaagttgaggaacacgacctgctgcagggattttccgacaacgcctatgacctcatcatcacccgcagcaacatgctggacagtaaaacccataccttccttccattggcagaagacaggctggttgcaatcctgcctgaaaaccacagactggcagacagatcctgcatctccctgagcgacattgccggagaggggttcatactgatgcacagctatacatctatctaccatttctgcatggacctgttccagaaggctggaatccgcctccatctgctgcgcacagcccgcatggaatccattatcagcgccgtggctgtccatgaaggcatcagcctgctgccggaggaaaatttcaggctgttccaatataaagacattgtctctgttcccatagagcccgccggcaagctgtccatcggcatagccggaaaaaagcagggacaggtttcatctgccatggccgaatttctccgctatgccaaaggttatacgcgctaaacctgctccggcacaacggcccacatgcggacaggaagtcctgtggctccctcaataggagggaacactgcaaatacaatggctccggccgcaggcacctggtccagattgcacataacttccacctgcagctttcccttgtccagcagatagcgctcacaggccaggtcccctgaccgggctgccagtaccgatgcatccgtatccaacgtttcgtgtccgttggcagccgcgttccgcacctcatagatgtatctcagggcctccatggaccaccccggaaaatgctctccgccctcctggtcaaaatttgaaatagcgtccatatccggccaccgcctgctccaaccggtataaagggccacaaaagccccatccggaatatccccgtacgcggcctcaaaccctttgatgtcatcaacggtcacagcatattccacattttccttcactttttcagagatatcaatgaccaccaggggaaagaccatgtccttgacgccgtactgctccgacaatgcctcccccttgataaaatgtcccggaaaatcaatgtgcgtgccgaactgccccggaaatttgaaggtctgaatcagacattccagttcatttccccagtcatatacggtttttgaaagttccacagccccctccggaattcctccccagtacgggctgtcgttgttgagcgggtgggacagctcgacccagcggcacctcttaagcctctttaaatcttcccataattcatacatattccggttcctcctgtcgtatttttgctacttttgttacattctaatgactccattatagcgtgtacgctgggtcattacaagaaaaatacgcccacctttaatatcacctttaatatcatcccggaagcaccgcattcctgtccccggttataccgcaatccttcagagatatctttatactggtaaacggcagcgggatacggtaatggtcccaccgccagttcaggcaaacagctctggaatacccggcctggacttcgatgaaattcttctttcccttttcagccaggtaaaatcccagggttttcggaacccttcttggccccagaggtccgtccatggctgctgccagagtctttccgggacaccctgcctcctcaatcagatttctcagaaaatcccggctcctgcagccgtccggaacccttatggcctttccattgcagcgtttaatcatattttcaatataatcccctcgcccgtctgaggtcactatgaccgctatgtcacgtccctccgacagtctcctgagcagcaggttcatcaagaagctgtcctcatgccagaaaccaatgacagcgcccctgtcaggcatatctttggtccatatatccggcatctccacttccagccgcaccgtcttctcaagcagccttaaatagccgtaatatagacggcacaaacatgcctttgccatgttctccataaccggcatcctccttctgtcctgtcataagtccgtactgttctgctgccaaagctgcaatccgtccggattcatacaattctgctgtcttacgggcctcctccgatctaccggaccagacatcccgctccaataccagccgggccgcagcggcagcaaaagcctccggatgttcttctgtcatatatccgtttattccctgtctgactacatccacaacgccggaggccctaacggttgctacgggacagcctgcagccatggcttccagcagcacaattccctgtgtctcagacttggacgcaaatagaaaagcatctgccgcattcagataatgccgcacccgggtattctccggaagccatagcctcatataacttaaaatggtggagatattcctcataccgggtgtggtaggtgtaggctaccggtatcttgtatttctttcccagatacagggctgtctgccctaccagcacaggatgatggacatgaatcacatcaaaattccccttcctgaaatatgcttctatttttctatcaaaacagtttcccaggatcatccctctgtccgcctttcggtaaaaaaccttaaaacacaccacatccctctcctgctccgctgacagctttccttccggttcaggagcaaataccgtaaccctatggcccagtgaccttaatccttccggcagccgttcaatggaaatcggcactcctccaataaatggtttgtaattgttggtaaacattgcaatattcatggggcctccttctatgataacaactgaaacacctggtcgcccatcacatatccggctccaatcaggaaaaaattccagacaaaaatgccaagggctgaacttatggtatatttaacaaaattcattcggatgacaccggcaggaatagagataatggtacgaatcatgggaatcagcttgctgatgaatattccggctgctcccctggtcctgagcagttcgaagttcctttggataaccggttcatgtttgggaaagcgtttcagataacggtccagaaacaagtcccctcccatccgtccgattccatataaaatccagcttcccagaagtccggccgccaggccaagggtcattaccatgaaaaaactgatctgtcctctggctgcccatatgcctgcaagcggcataataatcccggccgggaatcccggaaggttcatatattccagcagtatgattacaaatataaaaacagctccatatctcagaaagtattgtgtcagcatctgaacatccatatgtgattcctcctaatggaccatatcataaatcaggaatctaaacttgccctccaaaaaaagcaaaaggatttctaaagaagttataagtaatttcctatcacccccaccccatctcccataaaattatggggataacttctccattcattttggtgtcagaataatttcagcaaaatacagcggcagttctgtctggcgggcgcccttcaggtctgcctttattgtcagacgttcccctgaagatgcgggactcctcccaaatggacatagaaatgaaggttccggtaaacataggaaagacaaaagcgttccggcacaaggttcatccctccttatttctccaaccttccaatcagccgttccagcactgccctgacagccgccgggtcctttcgtcccggcggcaccctgcgccatccctgttccagagtggtataggccgcgccgcagagtgtgggttcccggcacagtctaaacccctcacaatccatctgcaccatccaggacgttcccctgcaccaacagttcatggcaggaagacggatgtcgtcagcatctgcggccagaaacagacggtaggccggaaacgcttccaggcgcagggccagttccctgagccctctggcataatgggccggtgaaaccaccacctttcttttccccagaagggacaggctggtactgataaaacaggtgtctgccctgtgttccatttctcccagctgcagaatctggataaattctccttgtccgcctgtgagctggttctccaccaggccccgcagctgtctgttgatttcccttaaccgggaagctgccgcgcctgttatctcattatccctgagaatatcatcaaacagctgttctccggcgctcataaaggccggcgccggaagataggaaaacagagtctcaccggctcgcccctgttcccgcagcatcctggccgcctctgcacccaatcccatggaaaggccggaaaacatgggacggcagctggagagaaccatctccaccacatttctgtgctgaagtatggaataggcatccgtgtagaccgtagcggaggtctgttccggtgacatggacatacctgcaatgctcatggcgtgctccagaataaaaaaggaaaaccagtaaatgttctcatcataatactggtgataataccactgggcattgcgatggaatataagggggctgcacagctgaaagaatgccacaaacttgtcgaccgaaacagaaaaatgcagggccgccttaaaaacaaatccccggtccagcagccggaccatccgtaccacccattccctggcataggcagtatcctccagcagccatccggtctgctccgaatccacataaaacagctctcccggcgtctccatggcctctgcaatctctaaaaggtcggaaatggcctgacgccttccctctccgctggtatatatggcaatctccgctgtacagagtgcctcagcgcgaatggtaaatgcctttggcaccgtaaaatgccggtcattcagcacgcggtaaagcagcgcttctgttcccgacgatccgccggatatgccctctgtccccgatatttcctcctcctttgacaggctgccgtcccccctctttcggctctctccttcttccctctttggttcctccagaggaaccagggagcggagggcatccgtcagggccatggggttctgctccagcagcatcctgcatacctcatcaaaatatacggatttagcgctgagccgcctgctgccgctgcgccatttgctcacaaggctggcgtccacatgaagccttctggccagggctgctgtggacagtcccaggcggtccatcagataacccagcgtagataattttcgttctgtcatggaaatctcctcctctataacatcccttttatggaagcagcgtgacccgcggcaccactggcagtatcacccacagtaccgcagccactattaccggcagcatcgcttacaatatcaccggcagcatcgcttacagtatcaccggcacctcctctgacagacagctgtcatggtaccggcactgacaaagaggccaaacctcttttcaaacaaaaaatcccttgttatactatagacatatcagcaacttgcacaaaagtcaataaatatcaagaaagtttttggccaaaataacaactttttttaataggtctggtccggaacagacctgtaatctgaacaacaaaactgtatatcaaagaaaggggtacgcaattcatggcagagaataaggactataaatatgtagaccactatgattttaatgaggaacttcttaaacaggcttttgccgaggcccgcaggatttacaaggagcggggcttcatgcgcaagatgggctttggaaaggctcccgccattaccaccgtagatatggccagggcctggatgagtgagggacacccgtttacctgcgaccactctgaggaagtctgcgccaatgcattaaaggtactggaagccggccgcaaatcgggtgttcccatcttccacaccaccaccggctacataggaaaacagcagtgggatcttccccgctgggatgaaaaaatacctatgagcgccctggatatcaactccgaatggctggaaatcgaccccaagctgaaaccgcgccctgaggagccggttatccataaaaaatatgcttccaacttcttcgggacccatctggcccagaccctgaatttcctgggtgtggatacggtgattgttatgggcgccacatcctgtgcctgcgtaaggcatacggtcatggattccaccggatacggctttaagaccattgttccggagggaactgtgggcgaccgtgttccgggcgttattgagtggaacctgtttgacatggaagccaaatttgccgacgtggtgccggtggaggaagtggtcaaatatctggaaggaattgattccaacgtctataccaagcatgagcgttcactggattaaccgttaatccgccaggccaggttttactaaatatgatacgccggtccccattgtcaggaatcggcgtatcccaggtccatgaaaggagcttatatgagccttctaataaaaaatggaaccattttgaccgccgccagtgaatttacaggtgatatctatatcgagggtgagaccatccgccaaattggaacgaatctgagcgtaaacgccagccagaccattgacgcttccgggaaatacgtaatgccgggaggagtggatgaacatgtccactacggttcctttggcggtcgcctcttcgagacagcggaagcggcagcagcaggcggcaccaccaccattgtggactttgccccccaggaaaagggcgtaccgcttctggatgccatacggcggcaggcagccaaggcagaacacacttcctctgtggactttgcattccatgcagtcatcatggacccaaaggagtctgtattcgaggaagtcaggcatctgccggaggtgggtgtggccacactgaaactttttatggcatacaagggcaccgcattttactgtgatgatgaagccatactgagtgccatgatgaatgcaaaggacgcaggcgttaccatgatggtccacgctgagaacgcggacatcataaccattctgacccgttattacctcagccagggcaagactgccccggtttaccactactatgcccgtcctcctattgcagaggaagaagccacaggcagggccattgccctggcaaaagcagcggactgccccctttttgtggttcatgtcagcatacgggaagccatggaggccatcaggaatgctcacaatggcggctggcccattttcggggaaacctgtacccattatctgactctgaccacggactgcctggataaaccgggctttgagggagccaaatacatatgttccccgccgctgcgtccccaggagcatgtggacgccctctggcaggccgtgcgcgagggctggctgaccgcagttggttctgaccactgcgccctggacggaggatatgagggtgcaaagaaaaaaggcaccaatttttccaatgtccccaacggctgtcccggagtacaggaccggctggccctgctgtggacatacggtgtatgcaccggaaaaatcacccgccggaaattcgtggagctttttgccgccaatcctgccaaggtggtgggactgcccaacaagggagagctgcgcattggcgctgacgctgatgtggtaatcttcgaccctgaatggaagggaatcatcactaacaaagacagccttcacggcattgactatgaaccatttgaaggatttgaaatccagggacggccccagcaggtctttctgcgcggccggctggtggccgaaaacggcaggtttgtaggcgaacgcggcatggggcgctggcagaaatgcaagccctacggtctgtgttatgactattatcacaaataagcgtccccgcatatatccatatgcataaaaggtgcggcagtgtcacatgaagtttccgtgatactgccgcaccctttttatcattcacaccttgacccggcctctgacttacgccttaaccggacctcatttcttcggttttctccgcagctttagttcaatcccctgctcccctgccctttccagaaaaagtgtttccgcccgtttggccttttcctttagggagagcccgtccccggcttctgctgccagaaccttcattacgttccttatatcatgcaacgttagcagattgaccgcctggcagtaaaatgttttctttcgcccatcattataattctccaacagcatctccaggtgccgggacttttccatctgctcctcattataacgctccactcctatttcctctgcccgtttcatgtctttgaaccggtttctgtgtgtgatgaaggaatcatattcatcaattccctcatatatgtcacagggaaacgaacggcactgccagcaatactcaactcccgggtgctgtaagctgcaccttgccattgcgcatggctggttgccctccccgcccccgcagccgggacagtatttgcccagatacatggtgcagagtccgcaattaagcccgcacagggacagcagcctgttctcacgtttaaaccctttcatccctctcctccttttcctcattcagccattttccccaattataccattgattccatttgtctgccatccgccatgttaatataccgctaaaaatctgttaaattattgttaatacaattttcgttatatgacaataatttactctcaaatattaaaattatccagtgattatacacaattttgtcgatataataaaacccggttacatgttctgcagacattgacatacataaataaagagagggattggaaatggtgagtgttttaatgaaaaagcttgcaattgcagctgtggccggcgctgtcatggtatcggcttccggatgcagtctcgttacctcaggcaaaaggattatccgcgtgtcccacgcacagtcggaaacccatcctgaacacctgggaatgcttgcatttaaggagtatgtggaagaacatctgggagataaatatgaggtgcagatatttcccaatgaaattctagggtctgcacagaaggcaatcgagctgacccagacaggagcaattgattttgtcattgcaggtacggcaaatctggagacatttgcggatgtctatgagattttcagcatgccttacctttttgactccgaggaggtctaccggtctgtgatggaagacacagattatatggaaaatatatacaagtccacagacgaggccggtttcagggtggtaacctggtacaatgcgggaacccgtaatttttacgccaagactcccatcaacacgccggaagatctaaagggcaagaaaatacgtgtacagcaaagcccggccagcgtggacatggtcaatgcctttggcgctgccgctgcacctatgggattcggcgaggtatatacagccatccagcagggcgttatagacggtgcagagaacaacgagctggccctgaccaacaataagcacggcgaggtggccaagtattatacatacaacaagcatcagatggtaccggacatgctggttgccaaccttaagtttctaaacagcttaagtcctgaggaacttcaggtattcaaggaggcagcggccctgtccacagaggtggaattagtggaatgggataaaagcatcaaggaggcaaaacaaatcgcagcccatgatatgggcgtaaccttcatcgaaacagatgtggaggcttttaaggcaaaggtactgcccttacatcagaaaatgctggaaaacaacccgaaaatccgggacttttaccaatatatacagaccgtcaatgattccaggaaaggagaccattaaaccatggacacaatgcataagttaagggcagccatcatgaagatactgggtgttgtcattacccttctgtttatccttatgaccctggttggcacctatcaaattgtgactcactatttcttcaaccgccccagcaccatatccgaagagcttctcacctactcctttacctggatgtcgctcctggcctccgcctatgtattcggcaagcgggaccacatgaggatgggattcatggcagacaagctgaccggcacagcccgccggtatctggaggttttcatcgacgcgctcagcttcttctttgcaggggttgtcatggtatacggcggcatctccatcacaaagctgaccatgatacagattacggcatccctgcgcatctccatgggatggatctacatcattgttcccattgctggcctgctgattatggtattcagcgtcatgaacgcagcagatatgctgcacaaagatttcagtgaaccaggggaggcaaaggtatgagtatagctgtattttgtggtcttgtgattttcgctctgctggcagtaatgctgttagcaggtgttcccatcgccattgccctggcggtatcctccatctgtgccattcttccggtgctgaacctgggggcttctgttcttacgggcgctcagagaattttctccggcatctctgttttcagtctgctggccattccctttttcatcctggccggcaacattatgaacaagggaggcattgccatccgcctaatcaactttgccaagctgttcaccggcagcattcccggagccctggcccacaccaatgccgtggccaacatgctctttggagctatttccggctccggtacagcggctgcttctgccatgggatccatcatcggccccatcgaggaggaggaaggatatgacagggacttttccgcggcagccaacattgccactgctcccaccggccttctgattcctcccagcaatgtaatgattaccttttccctggtcagcggaggcacctccgtggcagcccttttcatggcaggctatattccaggcatactctggggacttgcgtgtatggtggtcatttacttctttgccaggaagaaagggtaccgcagcaccaaacgttatacaggctctgagaaggtgaaggtatttttccaggccatcccgtgtctgttcatgattatcgttgtcattggcggcatcatttccggcattttcacggccaccgaaggaagcgtggtagccgtggtatacagcatggtcttgtccatcttcttttacaagtccatcaggctgagggagctgcctaagatttttctggacagcgcagagatgacaggcattatcatcttccttatcggagtatccagcatcatgagctgggtcatggccttcaccggcatccccaccgctgtatcggaggccatgctgggaatcagcaccaaccgctatgtgattctttttatcatcaacattctgctgctgattgtaggaacctttatggacatgacacctgcctgccttatcttcacccctattttccttcccatctgccaggcgctgggcatgaataccatacactttggaatcatgatgatattcaacctctgcatcggcaccatcactcccccggtgggaactacactcttcgtgggagtaaaggtgggaaagacaaaaatagaacaggttatacgtcctctgctctactactttggcgctatctttatcgtgctgatgctggtatcctatataccgcagctgtcgctgtagcttccgggactcatgggttatgtataaataagttatgtataaaacaggttatgcataaaacattatatataacatgtatcaaggaatggccgcgctgtgagacatcgcatcacagcacggccattccttttatccttttgaaattcaggcttacgccttctttaacctcttatcctccagatgggaaacaatcactgcgcaggcagcatctcctgtaatatttaccgtggtacgtcccatgtcaaacagacggtcgataccggccacaagggcaatgccttccacaggaagccctacgctctgaagcaccatggccagcatgatcataccggagcccggcacgccggccgtgcccacggaagccagaacagctgtcagtataatgacaatctgctgggacagggtcaggttgattccataacaggaagcgataaacacagcgcatacgccctggtaaatggcggttccatccatattgatggtagcgcccagaggaagtacaaagctggcaacctcttttctggcccctaacttttccgcgcattccaggttaagaggaagggcgcccacagaggatgcgctggaaaatgccattatcatggccggtgccatgcccttaaaaaacttaaggggtccaatgcccgcaagggacttcacggtcagcgaatacaccaacgaggcatggagtatgtacccgatataagccaccagaagcacaaaggccaggctgcccagtatctggggtccgttggcagccacaaccggcgtaatcagacagaacacaccgatggggctcagtttgatgatgaaggacataaccgcgatggacacatcattggcactctccacaaagtttccaaacacctctcccttttttcccgccacaatggtgccaaagccaaagagcagcgccaccacaatcacctgaagcatggatgcctcagccataggctggatgatattgctggggaatataccaatcagtgtctggataaaactgggtgtttctgctgccgtatactccagagagctggtggacagcaccggaaatccctttttgaacagattcgctattacaagtcccagggtgaccgcaaaaaaggtagtacacatataatagatgacggtcttacctccaatgcttcccaccttcttaatatccttcatggaaataacaccgttcatgatggagaacaagacaatggggactacgatgaatttcagcaggttcagaaacagggttccaaagggcttgatgtacatttccgcaatgtccggccggctcatcaacagcatgcctgccacaatacctaatgccaatccggtaaaaatccatagtgcaagtggtttctttttcatacgcataattccccttttttagtatttttgcataaatgcaattataattataacacactcttaacactattactactaaataccaaaaaagtaaatatttaacaatctctgataccatccatgccgccgccacttcctgcttattacctcaaaccggttttacttgaacgcataaactgacatgatcgaggaccagcttccacggccgtaaaaatcctcatagccggccggataatgttcatttgtctcatccgtgcttatattttcttccaaatcagccagtttttgaagtccgcttccgtttgtgccaacgctccagatgctcatgcctcccgccttatccacgcggccaaatacaaggacggagccgtccccggttagaacagggaattcactggagtattccgtatcgttagtcagttctgccacatgaccgttttccatccggtaaagctggcgccatatgggatattccacctgttctcctgttctcagctcctttgatgctgcaaaaaatatgctttttccatcgtatgacacctgcgggctctggggcaccagaccgggtgtcttaagtttctcatgaaccgcgcccttttcaggcggtatcttgaccagttccttgtcaagcgccatttcccttcccgctcccgcaagaagaaacagggaattgtcctctccaaacaccacattttcattatagggcagaaccacttcctcctgttctcccaacggatctatcatagtgccggacaccgtatcatagacagccgtaccaattccgtctgcgcgcatggaacctgacagaacatcctgccagataaaaagcctggacgaatcaggggaccacttagccggccacagatatgggtatggttctccgtccgtctcctccatccgctcaaagaaaggcggctcctcaccgattatctgtatgaggacactgagttttttctccttctccagattcatctggagcatccagattccctggttctgttcaaacaaggaaaggccggggtctttcctgcggtccacgtacctgcgccgggcaaaggccagtttttttccatccggagacaatgtcagcttctcacactgtatccagccgccatccaccggttccggcttccaaacttcctcctgttcccggcccatatgcaccctcacgattcctgtttccccggagctggcataaaatccctctttcccgtccgggacaaaagacaatgctccatttaaaagcagttcttctttccccgtttcaatgctgcatccatagaaaccgtcctgacgcagatagccggccgttctcccatccgaagaaaataaagaggaagaaatatccgttccttctgccagcctctcagtactcactgccgcatcatctgcatcatctgcaccattacgcaaaacccttatcagataaagtccgtcattggccgcgtagaggacgttaagtttttccggcagcgccttcttctgctcctcattctgctcctcattccacttcccgttctgctccctgcccgcagcggaaactgttcccgatgcctcaatgtctcctttgttttcacgtgccccgctttcatccgcgcctcctttacagccggccagcagcacaagcattaaaaggccggccagacatgccgctgttggtttcatcccgattcctcctctgcctgaattatgattctattttatatccatgcaggaagaaaatccctctctaaaaaacaaataatatcttacgatttattcacagacaatctcatccttccggccaaaccactcttccggatctttatttacgtaatggatatcaaattcaaccaccctgtactcctgtattccatgaacaaaaagcggctcattgtccaggtaatcctgtaattggcctgcatcctctgcccccatgacagacagaccgccgctcatatccgccttcaggccggacataaaaatcatcccccgctccatggctgcccgggtgcaggccatatgctcattcatgatttcatccgtcattcttccggcgtcttttatgtttccttccactaaaaagcacttcatatttttgtatctcctgttctgttttaatttattttatccctgctcaaacttgtttataaaaagaaaataaggcatacattttttccctgatatggtatactataaaaactacagtatctgaaaaggagggttgcaggcttatgcttaatcctatcgttatcgctgcgtagcaaaggctgctgcagctgtaccataatccggttataatggaacatggccttacatagcctttgctttcccgcttaaaataaaccacaggagagcaacatgagctatcaaaaagcggaccgtatcctgccccgtgaactgctggagcaagtacaggaatacgtggacggcgcgctgatatatataccgaagacggccgggcacaaaaagtgctggggggaggggacctccacccggcaggagcttcgtcttcgcaatcaacagatttacagtgattatctgtccggcaagagtacggacgagctgtcctccctgtactgtctgtcgcttaaaagcatacagagaatcataggccaggaaaagaaaaataaataatcaaaaacgacccggacccatgcgaatcttccgcatctgtccgggctttttgatcccatctgtatgtctcaactttatttatcaaacaagaattaggttggtatccgcctgtgaggatgttacactttttactgcccgcagaccacggctcttagcccggcagacaggaaaggaacacaacatgaaagacatcaaatggactatacagtatgacaggccgcctgctcctctgagacactgtaaaaaatgcaatatcagacaggaattcgtaagctcaggtcaattccgggtcaacgcccagggaaagtacctggacatatggctgatttataaatgctcctgctgcagctccacctggaacgcagccatctattcccgcgtaaatcccggaaaccttcctcccggtatgctctcccgctttcactcaaatgacccttccctggctatgcagtacgccatggacaccgggttcctccgcctaaatggcgcccaggtacagctgccctcctaccacgtggaaggccaggttttccggctggctgactcacctgcatcaactggcccagactcatccatggttctgcggattgacaacccatacccgcttcccctgcgggtacatgcagtattaaaaagtaaactgcagctgtcccaaaaaaggctggaccagctgacgcaaagcggcaggatccaatgtgaagacggccgtgaactgaagaaaagcaggacaggaaaccatatacggctttacatcaccggcgttttaattccctgagtatgccctctgcgtccaggcccgaacacaaacgtccgtccaccatgacattgggcgccttccggcagttcttcaggcagtttctggtcttaaggcacacggtcccgtcctctgatatgccgttttttcccactcccagcctttttttcagttcatccatgacagtaagacttccctttgacgcacagttccttccggtgcagaggatgatctcatggttatagggtgctgtctttaaactgggataccgcttacatatggcctgcaccatggagtcccgtactccggccgcctctgctgcctgctccagcatataagggctgatgcagccatggacgtcctgcagttccctcagcatctccacaatagtctcctgcgaagaacgctgcggcagcccgcggtagtagtccaggatttccctggtctggtcatcccgggcttcattttcatttatctgcatatgctaaacctcgcttccagtatagctttggacctgaggggcggattttattcacaaaaacctgtttttaccgcatgagttttttacagcctcttttatatcaatcccccagatagtatatggcggtaaaatggcccctggaattataataaagtctgttccctgtcacctggccgcatataagctgtcctgtttccgggtccgccggaccgggaaaaatttcccgctggtgctgtgatgccctcaaaagcccggtatctgcgccggagacagcgcccttcatgatatagatatctcccttgtagaccgtcttcatcaccgtatcccagctggtctgccacaggtgatattcatccgtgttgtaatccggcctgatccctgtctcatatccctggcccgctgtttcttctcccgcttcatgaatcaggaaaccgtagggcgtatcttcctggcccggattcagcgacagcatccggctctcgcctgtaagctcattcagagtcacccttacctgtccgccctccaaaactgtctgaagctgctcccttgtaatggaggcaggaaccgatatctctcccggcacagcatagtacgcccccatatcctttgcctgagtcaggtcaccgctcagtccggtttcatcatacctgcccagatattgcagatagggcgcgggaggaaggtcctccagtccacactggttccgcccgtccagcttgtccctgtccgtatcattttccattttctgtatcagggaaatatttccagattctacatccgacagaatggaatctgaaaaggaatccggttcaatgattcccctgtaccaccttttttctgaaaaataccggctcagcacatcggatttaaactgccttccgttggctgcataaatttcattccgaagaagccacaggtcctctgtgggccacaggcagagatcggccctggacagatagcgcgaaaacacatcaggaaaggtcaggctgtcctcaaacagataatagtctccggccagtcctccctcccccttcactgaaatatgagggtcagattcatcatccatggcaaatttaatggtatatgtaagcgccgggaccctgggaacctcttccattgtctccggtgttatcttatatgcctttttgcccttctcagtcagtatctcagcggttctcatgctgtcataatagctggtatgcatctcttccggaagggtaaagacacatttcagccggtctgattcccagccttccccggagagttcaaaggacagaccgcaccgtatgtcccccgccttaaagaacctgcctgatataagctgattacaggctcccaggttttgtactgccctgacagcagttcccggcccttccggtcctgcgcccccggctggtgcggcatttccggcagccccggccgttcctgcattcccggcagcgctggcatttccggcgcccccggcattccctgcacccgcggcatttcccccgcccccctctgccggtttccgggacagccccggttctgttcccggggcctcatgtttttcagactggccgcccgcctgttcctgctgttgtgtgacgccttcatcccggggatatgtctgctttctatccttcatcccgcaggaagtcaaaaccagcaggaccatggcggcccatccagcccttacaatctgtctcctaatcactgtaacccatcccttccattaattcggaccggatatttccatcatttcgtcccacctgttcatcctcttacaatccaggcagccagacaaggcaccccgaagcagttcaatggaaaccggctttgccagatgtccgttcatgccggacatgctggccttctttacatcctccgcaaaggcgtcggctgtcatggctataataggaagttcccatatccgctccatgcctgaaccgcgaatctccctggtagcctcatacccattcatcacaggcatctgcacatccatgaataccgcgtcataataaagggcggggtgggagcacactgcctccactgcctcgcggccattttcagccatctccacactgactcccagaagttccagcatctccgacgcaatctgccggttgagctcattatcttccaccagcaggactcttaagccccgataggctgcctccggtcctgaaacagaaggctggatggtttctcctgtatccccgcacttatccaggcacagggtgaccgtaaacctggacccctttccccattcactctccacctggatatccccgtccatcatggaaatcagattttttacaatggtcattcccagtcctgtgcctggcaccttgctgattctgctgtcgtcggccctgctgaagggttcaaatatatgctttatatattcgggtttcatgccaatccccgtatcctcgatgataaaacggtaggttccggcccgctgttcttccctcttaagctcacatacacagaaggtgattcttcccccctgcggggtgtacttggcggcattttcaaggatgttcaccagcacctgcctgatgcgcctggcgtcccccatgacccagggattaaagctctcatctatttcaaccctgaactcctgctgtctgctttccatggaaatccgcaccatctccgctgcttccctggctaaagcccgcagatccaaggaattctcagacagctccatgacaccgctttcaatcttgctcacatccaggatttcgttaatcaaccccagcagatgggcgccggaggatgcgattttgttcaggtaatccctctgcttttcctcatcccctatatgcagctgcgccagctcggtcatccctatgatggcattcatgggcgtacggatatcatggctcatgcgggaaaggaagtcgctctttgccttatttgccttctccgccttcttaagggcgtcctccagcagaagctttgcctgccgttccttttccagggtttcctgctgtatcctgcgctcctcatcaatgttcctggacagggtaatctcaatcagatcatgggtataggggctctccaccttcaccacctgagtgaaattccagtgatagctcccatccccgcctatgtggggaacatccatggacaggatgcgctctcccctctgaaaagcctctgtcagagcctttctggtaaacttgcggccaaactcctccctgtagtccggatggaccccttccatctcaaactcaatcagatcgtcaaagcagccctccggatttggtgctttcaccggaaaccgctggtattccaccatgtgataagtattctgtgtcaggttcaccgctatcagcatctggtatgcagccttggctgccgtggccagctggctgatctccacattccgttcctgctccagtaaaagttcatcctggacatcccgaaataccaggacacaccagcactcatcctcctggtttcctatcctggcagccgtaaactccaccatgcggtaggtaccgttgtctgccctgcggcgcagcctcctggtgatttgcttttttccctctgtaaacatgcggagcatggactccctggaaaagttgtcattaaaacattccagatcgtccgggtgcagcgccttttgggcatatttgcggttctctgaaccgaaattcccctgttccggtatgtcgtcccacaccacatccttctggcagctcacataataatcccttgtcaggttggcaatgatgcattcgtcaaacacagtcaccaggctgctggcgtacatctggcggattttctgaaacccctgctcctcctcaaagttcaggcggtggggcgctgcggtaatcaccacagcaggcaccctgccctcccagttgatccggttggcagtgacatccactgttaatttaaggagcgggtcataacagaccatatggtttgacactctgtcccccagcatcttaaggggacagttggcgcacagttccggccatacttcatcacaccggattcccagagccgccctgccgcgtcccgtattccggcaccgctcattaaaatataacagccggcgggattcctcctcaatgacatatacgctggtttctgtcagtgaatccagcagattcatcaggttttcagctgtcatgacgccctccccatcttcctctattcgcttatctcagccaaatccgcccgaagcttttcagcccgcttaaactgcctgcagacatcctcatacatctttgtgtagtcctccctgtcctcccccgtcctcagaggttccacaattgtgcacacagcatcgtacagaggcgtcagccccatgttgcccgttacacccttcagggtatgggcggcctcaaaggcagacgtcatatccccctgttccagagcatctccaagtttactcaggttttcatcctgaaacagcattcccaggaacttcatatacattttcctgtttcccataaaccgtcccagggtaacctggtaatccgccccataggcttcaaatatcctttcaaaatcgtccatcttcttatgcttcctttccatatatgaaatcgtacagagtctggtacatccgttccggctctatgggcttggcaaggtgggcattcatccctgccgccttgctcttttctatatcatcatcaaatgcattggctgtcatggcaataatgggtatggttcctgagtcagcgttgctcagatggcggatgttggtggcagctgtcagtccgtccatcagaggcatccgtatatccatcagaatcgcgtcataataccccttgtctgatttgctgaaaagctccagggcacgcagcccgttctcagccgtatccaccttgaatcccttgctctccaaaagcatcatggccacctcggtgttaatctggttgtcctccaccagcagcacatgttttccggtaaaatcataatcattttcctcaggctgctgtgcctgctgctccttttcgcccagggctcttgaaaaggccgaaacaagggaggacttgaacatgggcttgctcatcaggaggttgaccccggccagcttcgcctcatgctcaatggaaatccagtcataggcagtcatgataatgatggtcacctctgctcccacgatgccgcggattcgtctggctgtctcaattccatccattcccggcattttccagtcaatcagaatcatgtcaaaataccggccttcatcccagagctttttcacccggtcaaccgccttccggccgctgtccacccactctgccttgattcccatttcacgaagggtcacaaccgcgctctcgcacacagccacatcatcatccaccaccagtgtcttcaggtgggagaaattgtaatcctgttttttctgattatgcctgagcttctcttcctcggtgattcccagcttgacatccactgtaaattccgtgccgattcccttaatggagcggaccgtaattttaccgtccatcatatccacgatattcttggatatggccagacccagtccggtcccgccatacagggaggtggtccctgtggattcctgtgaaaagggttcaaacagatgcggcaggaactcctcgttcatccccactcccgtatcatttacaatgaaccgaagtgaggcatcattcttggtctttctgcgctgggaggctgaaaaggtgaccttgcccccctcctgggtaaacttaatggcattgctcaggatattgatgagcacctgctggagcttcatggcgtcacctatatagtaatcatccagaaccgggtccacaatgcactcatattccacccccttgacatctgcctgggagtaacagatggaattaatgccgttgatgaactcctccgttggaatcttctcgcttttaagcagcattttgccgctctcaatccggctcatatccaggatatcattaattaacgacaataggaaccgggaggaaatgccaatcttggaaatacaatcctccacctgctcgtcatcccctatggactgggccgctatggtactcatgccgatgatggcgttcatgggagtccttatctcatggctcatccgtgagaggaaatcgctcttggcagcattggcctgctctgccgccaccagggcagcagccagctcctccttctgcctctgttcctttaaaaccacatccgtcacatcggtgcgggccacacatacccgctccagctccctgctgatatagaaaacgcggaaccgcttaacccgtgtcgctccggttatatcccgcatctccacaataaacgtataggcatcattcctggccagctgtgatttcatataatcgtaatccagcttttggagatactcctccccggccgtcccgtccatatagcggccggagatggcgcgtatctccgcctggaaccggctgcggtccggcagcatggtatccataccggactcatccaccaatatggtacggtacgccgtatcccgcagaatgtccacctctgttatgctctcgtaatccagctccgcgattctctttagaagctgctcctgcatctttttctccgtcacgtcctgggtatagaaaaaaaggatgatgtgaccattctcagggttctggcaggaatgcatgatggtgctttcccagaatattatgccgctgttgtttctgcgaaggaactcaaagcggtaatccaccttgcccaccgcgtaatcagacagcacccgctcccggttaaggcagtggcggattccatccccataaaccgggtccacggcagaggccgccaggttttcaatggtatcctcgtaggtatctcccacctttgcaatggatgtatctgcggttgacaggtaggattccagccggcctgtggtgatattgaggcttccctgtatgctcccgtccgctgaggacagttccgcaaaataggaaagctcttcctcatacatttccttaatccggtcacgcatctgcttttcttcggtgatgtccatgcataccgacatgatggcaggccggttatcctcagacatcaccttcctgcccaggtcatggacccagatataggaaccgtcctttttcctcatccggtattccaccacatactcctctgaccgttccagctggcaggccaccagctggtccaccctgttcctgtcatccggatgcatgcagtttgtgatcattcctccgatgtcagatacaaactccgtctcgttttcatatcccagatattccagcatcctgcggttgataaaataaaaaggaaaaccatcctctatgtacccgcccatcatgccgcccggcagagaatcatttaacagctcctggcgcagtctgctggtatgttccatgaccagtgttcccggataatgctccgcgtccttctggctgctggcaggctctgccacatgaaaactcttgaccagccattctcccccggacaggaccagggtaaagaaggccctcagataccaggtgtacttggagttcttaagggtcaaatccgccgacatattatatattccgtctgacacaggctgttcatagatgggagacagatcacattcaaagggttccggtatctcccggatatcctgcgcaagatatccggccatctgctgccttccgctggccatctcatcggctcccgtgcccacaaaacccacatcctctgtcaggaatgcaagggttccctctgcgtcacgctttacaaaccatgtgcggcagaactcccgtaatgtttcaccgggcgtcatctgtctcttcatatattttatcctcccccaaagtaagtatctgtcctggccggaatgcccgttcccgaggcgccttcccatggatggcccgcagtacgcgccgcctcaggctcctctgggaatggggccttcccgcaaaatcatccgcccccagctccatcgcccggtcctccattgcctcgtcctggggaccagtggctatgaccgctatatccgggaccattttttccctcttaagtacctccagcacggaaaaaccgtctgtccctgaaagggtcaggctgagaatcacagcggcaatcctgcttttgctgtcagccatacatctcagggccgccttgccgtccgatgcctccatcacctggaagcttccctcaaaggtctcccttacgtccccgcggtaagaggcgtcctcgtccgcgaccagaagaacaggaagcggctgaggttcccgggcgtcttcatcgcccattccctcctgctccatggctgtttgcccgtttctgagcagttcctcgaattcgtttatgggcattggtcgggcaaaataatacccctgcacatagtcgcagtccgccttcttaaggcgctccagctgctgcctggtctccacgccttccgccactacacccaggtccatccaccgggccagctccatgataaaatggaggattccgccgtcatccgtccctgcggactcatcctggataaacttcatatccagcttaagaatatccacaggcatcttacccagcatattaagggaggaatacccgcttccgaaatcatccatctcaatgacaaagcccagttcccgcagataacccactgtctcgattacctgctccgggttctccgtgtacgcgctttccgttatctccaggtgaagccttgagggctgcagtctgtatctgcgcacaattcccagcagcatgtctgccaggtccttatggtagatatccgccctggatacattgacggacacagggatgggaggatatcccctgttgtcccactccctgaggacggatgcagcccgttcccacacatactggtccagctttgtgataaagccgttttgctcgaacagcggaataaactctccgggagactgaaagccccacacaggatgcttccaccggacaagggcctctgccccagaaagcctgtggtccctgatcctgtacttgggctgcagatagacctcaaactccttcttggcgagggccggctccatgctgtccgttatggcctgttccctcaaaagacggttgcgaagctcatcgtcataggccgcgaaatacgttccataccgtcccttaatgctgcgggcagccaaaagggcccggtcgcacatctgctccacagacacattcctgtcagccacctggtaaatcccccacttcatcaccacattcctggcattgggaagggtatttatccgggcattacaccggataaacagctcatctgtgtaattccaccgccgttccagaaggcacgcaaactggtccgcgtggaaatggccgcagattccattcttcccggccacctttttataaagcctgccgatctcatttaacaggtggtccccggcaggaatgccgaatatatcattaatcagcttgaaattcacgatatcggagcagataatatcatactccctgtcaggatgctgcatcaggatttcccttacccgctgataaaaaaactccttgctgtagagccctgtaagccggtcatactgcaccagattaatcatggcagctgtttccctcaggtggatgatgctggccaccctgtgcagaatcacctgggccctgtagggcttggcaacaaaatcagccgcgccgtgtgacagcgccgcaacctcatcagattcgctgtcgctctgggtcgttacgattaccggaatggatgaaaaagaagaatccgctttgatatgagaaagaaatgtatacccgtccataacaggcatgacaatgtccagtaaaataagagaaaccatctctccatattccctcaggacagacagtgcttccactccatttccggcttccagcaccttatatctggatgacaggatttcccttaatatcattcggtttatttcattgtcttccacgaccaaaattttcttctgtgaaatcatcgtttcatacccttgcccggcctttacccgccgatgatactgcttatccggcggcaaaaccaggcttcctcttcgtttccttctatatatatcgtggtttcaccaaaatagacgttcttttgacaaatttccaatggtttaaatataacaaaaacaggtggaaaatgcaataggacgccacagaaaccagatcatatgagcatgcatctttttcattagtacggcctttttttgtgtatattgcacaataatggctctgcaattttctcaattattgccatagactaaaacttttttaggtactataattctttttaagataacaatttaacatttcttttgccaatatgtatatcctggggattggcccagagtctctaccaactaccgcaaagagttggctacatatcttaatgtagccagctctttttttctgtttgtgtaaagattcgcaccaaaattggcaggaaaagtaaggaggaaatcaaaaaatgaatattgtagggcagcaagtaaaacgtgttgatgcttacgggaaggtgaccggggaggccaagtacaccgcggatctggaaccaagagacatcctgcacggtaaggtcgtgcactctaccattgccaacggcctggtcaaaagctttgacttgacagaggcctatcaggtgcctggtgtggtgaagattgtcacatgcttcgatgttcccgactgccagtttcccacggcaggccatccgtggagcgtggaaaagaagcatcaggatatctgtgacaggaaaatactgaaccagagggtccgcctttacggggacgacattgcggctgtcatcgctgaggatgaggtggccgcagccagggcagcccgactgattaaggtggaatataaagaatatactccaattgttacagtggaggcagccatggcagaggacgccactcccctgcacccggatctcaggaaggacaatgtaatcgtacactcccacatgaccatgggcgaccgtgatttcacctatgaggacggacttgcgaaagccgggtccggttacgggccggaggaaatcatttccctggaaaaagaatacgataccccaaggatttcccactgccacatagagctgccagtctcatgggcctatgtggacaccaacggtaagataaccgtggtatcctccacccagattccccacatagtcaggcgctgtacagcccaggccctgggagttcccatcggaagggtgcgcattataaagccttacatcggaggcggcttcggcaacaagcaggacgtgctctatgagcccttaaacgcgttcctgaccatgtccgtgggagggcggcctgtcaggctggaaatcagccgggaggaaactatctccggcacccgcacccgccatgccatcaagggtaaatgcaggggccttgtgacaagggacggccgcatcctggccaggaagctggaagcctatgccaacaacggcgcctacgcctcccacggccacgccatctgcgccaactgcggcaatgtgttcaaggatctttacagggatgagctgggcaccgaggtggactgcttcaccgtatacacctcctctcccacggccggcgccatgagagcctacggcattccccaggcagcatggtttgcggaatgtctcaccgatgacctggcagacgccatcggcatggatccctgtgaattcaggctgaaaaactgcatggaggacgggttcgtggatccggccaacggcatcaccttccactcctacggtctgaagaaatgcatcgaggaagggcgcaggcacatccgctgggatgagaagtggagcgcctaccggggtcagaccggcccggtccgaaagggcgtgggtatggccatcttttgttataagacaggcgtgcaccccatctccctggaaacagcttccgcccgcatgatactcaaccaggacggctctatgcagctgtgcatgggcgctacggaaatcggccagggagccgacactgttttcacccagatggcttcccagacaacgggcatagcctttgacaaggtctacatcgtatccacccaggacacggacgttaccccctttgacaccggagcctatgcatcccgccagacctatgtgtccggcatggcctgcaggaaatgcggagaggaattccgccttaagatactggaatacgcggcctacatgctgagccatgatgtaagcgacctctccaaaaccgtgtatgccgatgaagtaaaggcagccgctgtcctgctccgggagactctgggacttaaggaaggggaactggtatcgccggatatgctggacatagaaaacagcaaaattgtggtaagcggcggggatcctgtgctctttgacctgtccgtggtggccgacaccgccttctattccctggaccgctccgtacatatcacggccgaggtcaccaaccagtgtaaggacaacacattttcctccggctgctgctttgtggaaatcgaggtggacattccccttggtctggtaacggtaaaggacatcatcaatgtccatgactccggaatccttatcaatccgctgaccgccagggcccaggtccacggcggcatgagcatgggactgggatacgggctttcggaggagctgctggtggatgaaaagacaggcaggcccttaaacaacaacctgctggactacaaaatcccaaccgccatggacacgccggacttaaacgtggcattcattgagctggaggaccccaccggcccttacggaaacaaatccctgggcgagcctcctgccattccggtggccccggccatccgcaatgccatcttaaacgccaccggagtccagatggatgtgactcccatgaccgctcagcggctcatagaaaaattcaaagaaaaaggtctgatataaggagaaggttatgtttgatatcaaatcattttatgaggccaaggatgtggctgacgccataaatgccctggtaaaaaatcctgacgctgaaatcataagcggtggtacagacgttctgattcgtgtcagggagggaaaggatgccggaagatccgttgtatccatccataatatagaagcattaaagggagtccgcctccttgacgacggcgatctgtggataggcgcaggcactgcgttttcccatatcaccaacgatgccctgatccagaaatacatacccatgcttggggacgccgtggacatggtgggcggcccccagatacgcaacaccggaaccatcggcggcaatatctgcaacggcgccacctctgccgactctgcttccaccatgtggactctggaggcagatgtgctgttagaggggcctgagggcaaacgcagggtgccggtctgtgaattctatacaggtcccgggcggacggtccgccaacggaccgaggtctgtactggcttcctggtgcacagggaaagcttcgagggctggagcggccattacatcaagtacggcaagagaaaggccatggaaattgccaccctgggctgtgctgtgcgcgtaaagctgagccaagataagaaacggattgaggatgtcaggctgggatacggcgtggctggtcccactcccctgcgctgccggaaggcagaggaaggtttaaagggtcaccctgtcaatgacagcgaggcagtcctggcgttcggcaaggctgcactggaagaagtgaatccccgctcctcatggagggcgtcaaaggaattccgtctgcagctcattgaagaattatccaaacgggccctggcagaggcaataaaaaaagcaggaggtgcgatcaatgcttaagattgtacacatgaaggtaaatggtaaagaagtggaactggctgtggatgagagggaatccctgctcgataccctgcgccagcgtctggggcttacatcggtgaaaaagggctgcgaggtcggggaatgcggcgcctgtaccgtactggtgaacggagaagccatagacagctgtatctacatgaccttgtgggctgaaggaaaaagcatcatgacagtggaaggtttaaaggggcccaacggggaattgtcacccattcagaaggcatttatcgaggaggcagccgtacagtgcggcttctgtactcccggccttattatgagcgcggtagagattgtgggaaccggaaaaaaatacaaccgggaagagcttaagaagctgatatccgggcatctgtgcagatgtaccggctatgagaacattctcaacgccatggaacggattgtggaggaggtatatcaggtcagccacaaaaccggcgggaccgattaactatcattttatagggggaaccaatcatgaacagcaataccaattgcagcatcaacaacatatacaaactggagggcagggtgccaatcgccaaggccatccccttcggtctccagcacatcctggctatgttcgtctccaaccttgcgcctattaccatcatagcaggcgctgcccagccggccctgagccaggcccagacagccattctgcttcagaacgcaatgtttgtggcgggaatcgccaccatgattcagctgtatcccatctggcggattggatcgaagcttcccgttgtcatgggcgtcagctttacctttgtcactgtcctcagcaccattgcagccaactacggttatcccgccgtggtgggagccgtgctcataggcggtatctttgaaggaaccctggggcttctggccaaatactggcgcagaatcatcacccctgtggtggcggcctctgtggttacagccatcggattttcccttttcacggtgggcgccagatcctttggcggcggatatgcagacgacttcggttccgcccagaatctgattcttggtaccatcacccttctgacctgccttctgtggaacatatttgccaagggatatttaaagcagctgtctgtgctggcaggcctgattgtggggtatgtaatcgccatcttccttgggaaagtggatttaagcctgattatgtccggcggaatcatttccttcccacatctgctgccctttatgcctgagttccatgcaggggccatcatctccgcctgcatcatcttcctggtatccgcggcagaaaccataggcgacacatcggccctggtttcaggcggtttaaaccgggaaatcacgggaaaggaaatatccggctccctggcctgcgacggctacgcgtccgccctctccactgtattcggatgtcctcccgtaacctcattctcccagaatgtgggcctggtggccatgacaaaggtggtcaaccgtttcacaatcatgacaggggcggcctgcatgattttagccggacttcttccgcctgtgggaaacttttttgcctccctgcctcaggccgtgcttggcggatgcaccatcatgatgttcggcaccatccttacctccggcgtacagatgattgccaaatgcggtttttcccagagaaacatagtcattgtctccctctccctggcagtgggcatcggttttaccacagccagcgaaatcgggatctgggatatcttccctgaattggtccagtctgtattttcggccaatgtggttgcagttgtatttgtggtctccgtatttttaagcctggtgcttccaaaggatatggatatcaagaccctggaagggtaaagattggctgcgggagcagctgctccatagatgagttatcatttatggagcagctgctccctttgctatgtcctgcaccgccggatattcttggtacttttttatactattctcagtttttcatcatttttttaattattttgtataattctctgtctttttcttccaatacatggtacaatctgtataaatattcaacaccaatcagggggaaatattatggctaaagaaatgattgcaatgcttcttgccggcggccagggttcccgtctctatgcgctgacccaaaaactggcaaaacccgcggttccttttggcggtaaataccgcatcatcgactttccgctttcaaactgcgtgaattccggaatcgacacagtgggcatcctgacccagtaccagcctcttgtcctcaatgagtatatcggcaatggacagccctgggatctggaccgcctgtacggaggtgtccatatactcccgccctaccagaaagcatccggttcagactggtacaagggcacggccaatgccatttatcagaatatctcctttattgaacggtacgatccgcagtatgtaatcatcctttcaggagatcagatctgcaaacaggactacagcgactttcttaaattccacaaggaaaaaggggctgaattcagtgtggctgttatggaagtgccgtgggaggacgcgtcccgtttcggacttatggtggctgacggggatgaccgcatcaccgaattccaggaaaagcccaagaatccaaagtccaacctggcttccatgggcatctacatattcaactgggacatcctcagacagtatctcatagaggatgaagctgaccctgactctgaaaatgactttggcaacaacatcattcccaatctgctgcgtgacggacgcaggatgtatgcctatcatttcaacggatactggaaggacgtaggaaccatctcctccctctgggaagccaacatggaggtcctggacccggaacacagcggcatcaatctctttgacgaaaactggaagatatacagcagaaacagcggtatgaccggccataagattagcggcgatgccctggtggaaaattccatgattaccgacggctgccgtataaacggacaggtcaggcattccatcctcttctccggcgtaaaggtggaggccggggcgcaggtggaggacgctgttgtcatgggcagcaccaccatcaaatcaggcgccgtggtaaaacattgtattgtggctgagaacgtgatcatcggagaaaacgcagtggtgggagccatgccctctgacggcgaaaaaggcgtggccaccattggtcccggcattgaaatcgggcccggcgccaagattggccccagtgccatggtaaagaataatgtaaaaggcggtgaagaacaatggtaaattccaatgcaaatgccctgggcatccttttccccaacagctatgattccctggttcccgatctggtcagcgagcgcctgatggcctccattccttttgccagccgttaccgtctggtggatttcatcctttccagcatggccaactgcggaattgacaatatttccctgattgtccgcagaaattatcactccctgatggaccacctgggctcaggccgcgaatgggacctgacgcgcaagaacggcggactcaacttggtcccgccttatgcagaaaagacagtgagcatctacaacggccgcgtggaagcactggccggcatcctggatttcctaaaggagcaaaaggaaaagtatgtggtcatggccgatacaaacctggctgtcaactttgatttcaacgcactgattgaagcccatatggccagtcatgccgatgttaccgtggcttacaaggaggaaccccttcccattgacctcatcgaacaccgtgacatcggaaaaagcctttactataccctggccattgacaacggccgcgttaccaagatgtacatgaactcctcggaaccgggagtgcagaatatctccatgaacatctacatcattgaccgggagctcctgattgaccagataaacactgcctatgtgcgcggacaggtattctttgagcgcgatatcctggcgccccagttagaaaggctgaatgtgcaggcatttcgctatgacggatatgtggcgcgaatcagcagcatgaagagctattttaacgagaacatgaagatgttagacgatgccaatgtggacgcgctcttttccgccggcaatcccatctataccaagattcgcgacgacaatccggcccggtatatcaacggctccaaggtcagcaacatcatggctgccgacggctgcatcatcgagggtgaggtggaaaacagcatcctgttccgcggtgtcaggataggaaagggcgccagggtaaaaaactgtgtgctcatgcaggatacggtgatagaagcagacgccagcgtggagtatgttgtgactgataagaatgcgaccattacaagggacaggattataaaaggcgctgttacgttcccggtgtacgtggcaaagtatcagattgtataggaagcagctgaatgtgctgaaaaaggagggtgtccacccgggtggggacatcctccttttgtctgtttctcctattatatgtttctcctatttctcctgcgtcaaagcattcatcagctccgccaaatcactgacaatacatatatggtcaaagggttcaaactcccggaatgacgttgttccggtcaatacgccggcaaaatccacagcggccgcggccgctgtctttgcgtccaccacgctgtcccctgtataaaggacttcgctccggtccgcccccagctgctccatggcataaagaagtccctcagggcatggcttctcagcctttacatcctcagcccccactattacgtccaccaggcctgctatctggaatttgtccagtatctggtcaatcctgtaatgatattttgtagtcacaattccaatcctgcgcccctgcctgcgaagctcctcaaacaccggcctgaccgcgggatagagccttgtatgctccaccatcacctggtctgatttttctttaaaacagacactgaaccgctgtgcctcctcctggtcccggctccctgtgagacaggagaaggtttcttttaaggacaggccgatggtctttcggatatcctccagttccccggcctcatatcccagtttcttaagcccgtggttcacactggccgcaatgccctctgtgcagtctcccagggtgtaatcaaaatcaaatatcactgccttgtacttcactttgctcctcctcatcacctcaaaatcttctccggccggaatctgagataatccgatgaaaccagcttatactcaatcccgtccacctctcccagaaagctgtcctgatacctggcttccccgtggcagtgggaatacaccacctgctctgccccgtactcctttgccatctcagtaaacccgctttccatctctccgatactggtaggaggataatgtaagaacatgataaattggctgtagccgtccgcagcggccagctcaaaggagatgcgaagccgctccagctcccttttcaccagcttctcaaaatgttccggtgaatcctttccctcatagcagtacccctttgtccccaccagggcgtacgccccgcaggcataataattattctgcagaaaggacagccgcccctgaaacatctcattcaggcggtatgttttctttgcatcccagaacatgtcatgatttcccctcagcaggatttttcgtcccggcagggactggatgaaatccaaatcagccagggcctcctccagattccgtccccaggaatggtcgcctgtgatgaccaccgtgtcctctgcgccaatccttcccctccagttcttctcaatcttcctcacatggtctttccattcccttccaaatacatccatgggtttattggcagtaaaggataaatgcaaatctccaatggcatacaaactcattttcacaactccccgcttattttcctgtaaaacagcaggcccggctcagggaaaatctgttctaaaccagctcctccagtttttccttatcccaaccctgcatctcatgtcccgtaatccggaaatatccctccttctccatcagcttcagctcctggttcagggaggacctgctgacatggagcatattggccagcatcagctgggagccgggcatgcggatggtctccgcaggcgcgatgtcatgcattcccacaatccagtaagcgatccgctcacggatggtctggtaattgaggcagttgagatagagctggtttttaagtccccgctgggagacatacagtagcagcgcatagagaagctgcctgtctttctccagcatctcttccatcacctggaccggcacccataacactgtggaccgcttttcagcggccagagtataactgtactccttttctccggaaaaatacaggaattccggaaaaatatccctggcctcaaaataagcatggcacatttccgcatcttttctggtgtgatccactgctttcaggattcctgtctccacgatgccaaagctggtaatctttgtcccctggggatggatgcactgggaagcatcgtaggtctttcttataaaataggtcctgaattcactgtttctcctgcaaaggtctgcaaagggaatcctgcaggactctccgggaattgaaaaatgttcatacatatgcggcctccaaaaaacatgaaagaggggctgcgaagaacagctcctcttttttgatacagtctatgcctgcggccggtccagtatgtcaccaaaatcatcctaatccttttcaccgttaaaccgtaggagcctccctgtttacgacatctgtctcatcgtccgcggccacgcagagtgctataccatcataatacggcaaagtgccggcaacatcaactacttttttctccgaagggccggcatgatgggattttaacgaatgcttttgccatacaccggaacaacccctggggcagttcaaacacaaacacaatccccagcacaatggccactgcggccttcacagcctcataccccgtatacacagccagtcccagctgttccgtcaccaggtaatagacggtccagtaaattcccgctcccggcaccaggggaaatatacctgatatgagaaaaatagtggcgggacagcggtttcccactgcggctgccctggacaggaatatgaccaccaccgtggcggcaaaggaggcgcctgccccgctgacataaccggaagccagcacatatacagcccatccggctcctccgataaggccgcaccagatataatattttctcggcactccaaagagcagtgaaaacgcaatggttcccatcatggctgcaaagacctgcgatatcataacaatgtacctcccgtcacccatcctgccagtgaaaatcccacgcccacgccaatggctatacagaaaaatatcagcagcgcatccatcatccgcactgaaccggaaatgtaatcactgtccgcgatttcccgtatggcattggtaaacggcaccccggggataaggggcatgatggagccgattaccatgtaattcagatgctgtcccatccctgccagatacatggcgctgcacaggatcgtcaccagggctcccccgcttatgtttcccactattttcgacagatggggggcgctgacatacagcacgtagatgtacaaaatgataccggtcaaaagcgccacagcgctgtcccatatactgcccccgaacagatagcagaaggcagcgcagccgcagccggatgccagcacctgcatgtatttaggctttcccggcatgcgctttatacattccagtctttctgccgcctctctgaccgtatacatgcctgcctctatctccctggagagctggttcacagccgccacccggtccagatgagtcccgctcaccggaatatgctccaccttggcaaaatcaggctcattccggctccccactgtgacaaagatgccgttggtgagcacaaatgcattgccggaacagacgccgtaatagcggcatatccgttcgatggtttcctccacccgggaaatctcagctccattctccaggagcagatgccctgcctgaagggaaacctccatgacttccttctctctgttatcctgtttgagattattctgtttatcattctgtctgtaattactctgttcctgcccgtatataatttgattctcctgcattgcctgctcctgcctggttctcttttttggcctggcttctctttgtcctgacttacattgtttcgtttcctctctcattttatcattccaaggaaatgcttacaacatgaaagttcaccgagcatggcttcaccgctgaatccatacgggcgcgaagccgccgcaaggcataatccccttgccatccaaaacatattgattcaggaacaggcgactatataatccattacagcgtacagtaaacgtacatgcgcaccacgtatagatcagaccggatctatattcctctgccgctcaaatcccagatagcgcgttccctggaaggtcagttttcccctgtccccctctgccagcagcccatattcagttcctgtcatggagagctccatccggtcaccgctctccacctggaatgtggcgtaatagctggtggatgtggtagagtggaagccgtgggctcctgtggcatcccctgcattggggtggctgtgccggctgacattggtccttttggagaccacagaagctgataccgacagtctggggcagtggttgttcctgttccactggctcagtccctttaccgccgtgaccacaaacacccctatgatgatcacaaataccagggtaaacatgatttcaaaaccgcctccccagaaaaaggaattcatatacataaatctccgcctctctttcccgttgtatacccccatattatcacatatgcagccccgcaatgttacaatttgcttaatataacctaaatatttccatacactggaaagggccccggatatctcacccggaaccctcttcggtataaacctgattttattcttattatcatatttgccccaaaagcagcctgatttctataaacgttcatgcccgtcttcccacaggcagcagcctccttttttttctgccttggcgcgatacagggcctgatccgcacattccagtatggatgacagcggcttcctggtatcccagataaccacacctgcggaacagcaggccagaaccttgtcgtcaaagggatactcactaatgctcctgcatatgtcctccccttttctgacagcactttcccctgatttcatctgcttcatgatgaccacgaattcatcaccgcccaaccgggacagtatatcgctttcccgtgtctgaaccctcagaaggttcgcaaaggctgttatggtctggtctcccctcacatggccatatgtgtcattgatgagttttaagttatccaaatcaaagagatacacagccaacggcatgtctttcccgtccagggcattggcggcagcatccaggcctctgcggtttaacagcccggtcagaaaatcctgacatgcctcatcctcaagcatgcgctcccgttccctggaggacgccgacctcatggctctcatggcacgcttttccaggacggctgccgtatggggcttgcgcaggaattcatctgcctccatatccagagccttttcctcctggctcccgtcccacgaggtggctatgacaggtatattccatacggcccgttccctctgaagcatttccagtatctgaaatccatcgggctctgacagggttaggctgatgatggctgccccaattttattctcgtagctggcaatacaggcaagggccttctctccgtccgacgcctccacaatctgataccgggactcaaatatcctgcgcacctgcctgcaataggcttcatcctcatccgcaaccagaagtacaggacgctgttttccgtataaggcagcctcctccatggacgattccatggctgcctcctccggctgttcctttatcagcttctcaaactcaccgcagggcatgggcttggcaaaataataaccctggacataatcacagcctatttcccgcagctgttcaaactgttccctggtctccacgccttccgccaccacgctcaaatccatccagcgggcaagacccatggtaaaacgcaggataccctggctggcctgcttttccgtttcattctggataaacttcatatccagcttcagaatgtcaatgggcatcttattgagcatgttcagggaggaataaccgctgccgaaatcatccatctctatgataaagcccaattcccgcagccgccccgccacctcaatgatctgggaggggttttccgtatacgcgctttctgttatttccagatggagccgggatgggggaagcccgtatttttggactgtctctgtcaatatttcaggaagatccacgttataaatatccgccctggacacattgacggaaacaggtatctccggataccccattttctcccatctttgcagaatggcgcatgtctggtcccacacatactggtccagccgggtgataaaaccattctgttcaaacagagggatgaactgtcccggcgactgaagcccccattcaggatgattccaccgtatcagggattccgcccctgaaagccgctcctgctttacgctgtatttgggctggagataaatctcaaactgtccttctttcaatgcggattccatgcattctgtgatagcctgttcccgcagcagcctgctgcgcagtcggtcatcatatatggcaaaatattttccgtactgccccttgatgccgcaggcagccagaagagccctgtcacacatctggtccacaggaatggtgcggtcttcaatggagtaaatgccccatttcaccagcacattttttgcattgggaagggcgttgacccgggccgttgcctccatgaatatttcatcggtatacttgcacctccgctccatcagtatggcgaactggtctccgttaaaatggccgcaaatccccttatcccctacctgggactggtaaaaatcagccacctcccgcagcagcctgtcccctgccggaagcccgaatacatcattgaccaatttaaaattctcgatgtcagaacaaataatatcataattccgttccggatggcgggccagttcctccttcaccttctggaagaaaaattccttgctgtagagccctgtcagccggtcgtattttaactggttgaccatggctgcattttcacgcagattgatgatgcttgccactctgtgaagtatgatttggggcttgtagggtttggcaacaaaatccgatgcaccgtgggaaagggctgccacctcgtccgattcgctgtcgctctgggtggtaacgataaccggaatggaagaaaagacagggtcttttttcacaatggaaagaaaggtatatccatccataacaggcatggttatgtccagcagaatcagtgaaatcacatccccgcgttcctttaggacggacagggcctccaggccgttttcagcctctatgacctgatagtccgcagatagtatctctcccagcagcatacggttaatttcattgtcttccacaatcagaatttgtttttgtgatatcatgtccttatccccttttatctgtatacgcagtatctggaccggccggcctttttggcctggtacagggcctggtcactgcgctggagaagcgcgtcaatgtccaccatggaatcgctgctctgggctattcccacgctggctgacaaggaaacggtctgctccgctgccataaacgctgtcttcatttctttcagaaaggcctctgcctcctgctccagctggtccacacagcacctgcccagacggaccaccaaaaattcatccccgcccagacgggccacaaagtcatcccggaacaattgtctgagcacatccgccgtatgcaccagcacggcatctcccaccttatggccataggtgtcatttacttccttaaaccggtccaggtcaatgtacattaggctgactgtcctgctgccccggttgttgtgtatgtactgataaaaacatctgcgattgtaaagtcctgtaagaaaatccgtattagagctgtgccggatttgtttctccagatcacgctccactgtcacatcccggaaaatgcaaagcttgccggccacatgattaaatacgtcataaacggagttttcgtgaatctccagcatcttacctgccccgtcctcccgggatacccgcgcttccacgtatccttcgctgttgatggtgcgctgttcctcaaaggccccggctatccacacatcataatcccggcctattacagcttctcttggaagcttaaaatactcctcaaatttccggttggcattgagtatcttcccgttgttatcccataaaagaatggcatagggcatgctctgcagcagaatttctatctcagcgctcatgttgaccagatccgtcacatcatggccgattcccacggttccgagaaccgtgattccgtccctgtccactatgggggacttataggtgcgcagctggcgcatgccgtgggatgccttgacagactccgtaaactgcagggtacggcgttcctttataaccgcatcctccgattcccggcatgatgcctccccgttttcataatcatccggggataccccccatatatagcagtggttctgccccgtcacatcctccctggtctttcccaccacagagcagaatgccttattcaccttgacgtgaatcccgtccagcgtcttaaaccagagcatatccggtatactgtctatagccgtatccaaataggtctgggttatgtaataatcgtagcccagcttaatctgttccatcatgcgtttcaggcgtaccttaatataatcccagacaaggggtgtctcccaaaactcttccgctgcctcaaattcttccggatccagggcgcctaagcgctggcggctgccgcagaatatgagcaaggcatcccccgcacaccgggagcgcagcacagagggcggcacagggtcgtccagattccatatgatcagcctgctctccctcatgatttcctgatttgcctcaggcgccactgtgatttcatgtgtgaaatgctccaatggttcaagagaacggaccagctcatagagcatggtatccttactgaaaacagctatcttcatcctgcatcggtacatatgatttcctccccgcggaacatcagcttttcccaaatgtatattgtttaattgtaacataagcaaaatctttaatcaacaatatttaccaaatagagcggcaattgaacggcaaccgagagacaattgagaatcagcggggcaccttctcctatctgttttttcaatctcaaatcaaatcttattcagaatatcaattggactattttttcccggttatttatactcaaataggtataaaagcaagcaaacaagggagattatatgtttagtttagggattgattcaggctcaaccatgaccaaaggggtcctgttcgacggaaggaacgtggtaggatgccatatgcttcccacctccatgcgtcccggcgagatcctaagggacatttacagccggctttacacagaggaaaccgggttcgtggtgagcaccgggtatggccgtgagcttttaaaggaggcagacgcgaaaatcacggaaatcacctgccatggagcgggcgcttcctatctggcccccggctgtgataccgtcattgatatcggcggacaggactgcaaggtcattacccttgacagccatgggcaggtaaatgattttttaatgaacgacaaatgcgcggccggcaccgggcgtttcatggaaatgattatggcccgggtaggaagcagcatttcacatctggacgatttcgtacaagactgccggcccgtacccatcaacagcatgtgcgctgtttttgcagaaagcgagatcgtcgggctgatggcccaggagacgcctcccggcgacattgtacttggatgcgtccactccatctgccgcaggaccgccatctttgcacagcgtctgacagggggccatccccatatcttcttctcaggaggcctggcgcagtcagagattatgcgatccgtactgggagaatatatgaacacctcccacataaccactcaccctctctctcagtataccggagccataggcgccgcggtgctgggatacgggaaactaaagaaaaggatccgaagctgatatggagttaaaaaaagaactgcccgaaatatttgaggaatttgcggatgcaaggaaacattcatttcttgccataaaagaattaaaggaggagggcatacctgtggtcggtgttttctgcacctatcttcccagggaaatcccccatgccatgggagcatctgtagtgggtctatgttccgttacggatgaaaccatacctgacgctgagaaggatttgcccagaaacctctgtccccttatcaaatccagctacggctttgccaagacagacaaatgtcccttcttttatttctccgacctgatagtaggcgagactacctgcgacgggaaaaagaaaatgtatgagatgctggctgagttcaagccggtccatgtcattgaactgcccaactgccagacagaaaccggcataggcctttaccgccaggaactgatacggtttaaggaggtgctggaaacgaaattcggcactgtcatcacagaagatgccatccgctgccagatacataacagaaaccagattcttgcggcccttaaccgccttcagtatgtgatggccctggacccggcaccggctcttggactggatatcgtcaacattgtttacggcacgggatttaagatgaaaattgatacactggcagaagaagtaaacgccatcacggataagattgaggcagaatacgcccggggcaggaatattggaaagagggccagaatcctggtgaccggttctccctccggcggtgccgccctcaaggtggtgcgcgccattgaagataacggcggcgtggtggtctgctttgaaaactgctccggcatgaagcccttagatcccattgatgaggataaccccgacgtatatgacgccctggccaggaagtacctgaacatcggctgttcctgcatgtcccccaaccccaggcgtatggagctgttagacaggcttattgacgatttccatgtggacggcgtggtggatttggttctgcaggcatgccacacctacaatgtggaaacctccctggtccgcaggctggtgaaggagaagaagggacttccctataccgttgtggagacagactattcccaggccgacgtgggccagctgaacacaaggatggctgccttcatcgagatgctataaggaataatctatcacgattttcctgcatgctgcgcagcaataggcgttttccactaccgctgcccccagtgtctttctggctaactgtacgccgctgttcctgtcattacgggaaaccagaccgggctcatggcgctcccttctccatgcaatgcagcgggcgtctgatgtgaggaatcctgcttccatctcttgattgcaataaggacatttcatttcttccactgcctccttgttttttcattgagcatagcacagagaagaaaaaaacacaataagctcccgcataggccgggaattggacggctggtttcaggaaccggtgttgcagtgtcattttccctgggttataatatttagtatgtcggacaaagaatcaaaggaggagatacatatggtagaaataaacagaaacgcctgcaccggctgcgggcagtgtataagtgattgtatcgcaaacaacctgtttctgagggaaggaaaagcagaggtgtccggaaactgtatcctctgcggccactgtgttgctgtctgtcctttaaacgccgtgtccataccggaatatgatatgggagacgtagaggagctgagtcaggaacaggccggaatggattcagaccggcttctcaaggcaatcaaattccggcgcagcgtgcggaggttcaaacagaagcctgtcagctccggagacctggatatgctggtgcaggccggacggtatacagccacagccaagaatatgcaggactgccgctttatctttgtccagaaggagctggaaatcttaaaaactcttatctgggacggaatcggccgtattttggacagccctgctccggggccggcccaggcataccagggcttttatgaggctcatatggctgattcaaaacaggactatctcttccgcaacgcgcctgccgtcctgttcatcgcttctgaggcaaatatagacgcagggctggctgcccagaacatggaactgatgggtgtctcactggggcttggattcctctataacggctatctgagatgggcagctgaaatgaatcccgaggttttagattggctgggagtgggagaaaaaaagatagaggcctgcgcccttctgggctatcccgatattacatataaaagaacagctcccagaagggcggctgatgtgattttccgttgaaatcacggttttcctctacatccgcctcataaaagcaatatctgctccggctgatgcaggattcatctcctcccggagcagatacatgtccggtttgttttcatgaagccagcggctgatttcttcataccgcaggatgcctttgcccagctgttttggctggtatgcgcggtctttccccaggctgtagtcttttatgtgcatcacgtcaatatacgtcccgacggacgcaagccactggttccagtaagcatcctgatccgtggtctccgggaattccaacaggttggaggcgtcgaatatcagccgcaggtgggccgggtcatccaccatccggattgtcttaagcgtggtctccaggtccgcaagaggatgccagtacacgggttcgattgccagcttcatgtcaatgcgctgcgcctcctccataacccgcataaggctgtccatcatgtacggacaccaggcagccctttcctctctgctcaaacgtggataggctgtctcggttcccaccacgccggctcccatttcctttgcataaaacaggcaggttttcaaagtctcaaccgcatactcccttacactgcggtctggattgcccaggtccatgtagcatcccatcaccggaatctccacccggttcttctcaaatgcccttctgattcgctcaatgtgggacagccggatatcctcatagctgtcaatctcctcaaataccttgggaagcgccagctgggccccatcatagccttcttcacgcagcagggatgccagcccttctatactgtgtttaccgtaatcgtgtgcgcgtacgcctattttcatcttgtatccctctctgtttgtattgatgtctgtttgtattaatccctgtctgtattaatctctgtctgtagtctgaaaaacagcccatcatctatcataatacaggaataccgtctgaaaacaagaacgtggttcgccaaagaatgtgtccttatttgtatctttatgccttctgctgctgcccttactgtcttacaggaagcatcaccagaatctccgccacttcattgtccgtggcaacccgctggggaggcccccaagttcctgcgcctgaggtaacgatgacctggggcgaatcaacggatgcccggtaatatccataatccacatcaaaaaccgcatccgtaatcagattgaaggggaacatctgtcccttatgggtatgcccgcagagaatcaggtctgtctcttccccgtagtcccggatatttcccggctgatggtccatcacaatcacaggcagatcctccgtcctttcaggcagttccaggctcccccgccgctctccctgcccgccgataggaaatgagtccttccttcctgccagtacaaaacggctgtctatcacaacggcctcgtcctgcagtacccggatgcctgcctctgagaggaattccatcatccggtcatagctggggccggcatcatggtttccgaggcaggcgtaaacaccgtaaaccgaatctatttgcagaaacaggtccttaagagtcccggcgtcagccagggccgtggcatccccgtcaaatatatctccggcaatacagaccaaatccggcttagtggagtttaccgcgtcaatgaccttttcaagatgatgtccgcctatgacgtaccccagatgcaggtcgctgatcagggcaatccgaagaggcgccttctcttgtgtcctgcccccaatctgaatttcgtagggttttatctgtatcacagcaccatggacagccccatacacggacagggccgccgaaagaaacagcggtatggctcccgcagcaacaccggccctgcatgacagcggcgccggcaagatacgaagcagtcccgccaggaacataaacaatcctgccagattgactaacatcaccatatagacaatgaaccccagaagatagtggcagacataaaaaacaggcgcaaacatgccattgccgggaacacggctcacaataaaagcgcccagaatcccgataacagccagaccgtaggcaattccatagggcaaggggcctatacacggaaaaagaggccccagccactggaacaatttccgtccggcattggcgaacaatccgatcacagccgcaagtgcggcaaacaggcttatcagtttcatcctatactccatctctcttcctgtaatgaagaggcgtgcatcccatgtacctggtaaatgtattggaaaagtggctgcttcccgaaaacccggctgccagcgcaatctcaagaatgctcttatctgtgtgggtcagcagatactctcccatgcgcacccggtaggaaataagataatccaccggggactggcccagtatctccttaaaatccctgcagcattcgctggtgctgacactggccgccctggcgatatcctccagccgtatcttcctggcatactcctggtggataaacgtaaggcaggaacggacccgcctatatgggacatcggaataggaagtctgcttttcccgttttaagtccatgttttcgtacagcgtaagtccggtctgctgaagcagaatctggagacgccacaggtaccccggaggccgtctgcagtcgcacagatacatgtcatgaatgcaggacaatgcctccttatgccatggacatgtattgtccaacagaaaaaaatccacatcggccccggtaataaaggaggcgcactgcgcctctaccaatccgccggaaaggccgtgaagcagataagggtccgccagcacggcgcagtaggcgctgccgcgctgatggtgatagggagtgaccatatgcagcatattaggaggcagaagcccgccctgtccgccggaaagcacataggaacagaccccggtctgaaactcgatggcgcctctcagcacgtagaccagctccaattccttatgccagtgccatggaatactgcggttcgggtacaaatccagatcatccagatacacctccatgggaaacgcaggcgtgccgtggcaggtaacctcctccagatttccgtttacatccagatagtttaactgcatctgaaacctccttccagagcaagacaggattctgttatttttagccgctatattattacaaatatttcaataactccattataatgaaaaaaagagacatatgcaagaaattctgtttcaaaggagtgattatggagatgaaattaacttatattgccatccataccgcaaaaccggagagaatgaaggatttttatgtgaaatatttaggtgcggttgtggatgaaccgcgccctgttggcaaggaaggaccggaagcggataccggcctggcagaccgcgcatcctgcaggaccgtgtacaacctgtcctttgagggcggagtgaaaatcaggctcgtaccggaacggccggttattggtgatacctcatccgccgtatcccctgccatgcaggcccgcccctcctattcggtatgtctgaccttcacagtgggcagcaggaaacgtgtcaacgaactcaccggccggctgataacggaaggttatgatgttatctatgagccggggttttatgggatggagcattacagcagcagcgtttttgacccggagggaaatgtaattgaattggtggcgtaaaaaacaactgcgggcagccggatggggccatccggtacctgtcaaaaaatgagccttcaaagggatttatccctccagaagactcatgtgttctttgtccaggaccagaaggcatccacccaggccgaacccgctttctgccaataatccttctcttattttcacctctctgcgtatggtgttcatcttcctgacatccagcgcgtactgcgcattcctgagaatatatgaaacgtcaaaggacgcagagactacaacttcggatatatcgaataaattggccacattcacgattccgatacccaggtacctgccgcaggtctcaaaaacctgcagggctgccttgtccccgctctctgccaaaggcaccaaatcacctgcctgctttatctctttccctgtaagctcgctatatatccgcatcattgccttctcgcttgtatagagtcccagacacccgcggctgccgcatttgcattccagtccatttttatcaaccgtcatatggccgattcggcctgaatttcccatctctccctgcatcagactgccgtctgtccagatggccatgccaatccctgaacggataacaatatagagcatattctgtacatcctcaagatgggccgcttttctctccgcccaggaaagaaggtttacatcattgcatatatagaccggcttacccacatatctctgtatgatatctccaataggtacgttctcccatccctcgatccgttcaaacagcactgaatgattatgtttatagtcaatcactcccggaattcccattccaacccctaaaagccggtttctgtcaatacctgaatccagaattaagtcatctatctgctgtttcagcaggcgtatcatctggtctttatctgagtccctggggtagacacggacagaaaagcagatgtttttacattccagattgctgatagccatgcgcactttcggaaactccaggtcaattcccatggcataagccgcacctgcatttgcatggtagagcacgggacttctgccgccgtttgatgtgccgtaaccgctctttaccaccaggttgtccgctgtcatttcctgtaccaggctggttacggtcggacggctgagatgggtcatatatgctatatccgtcatggtaactgccttatgggaccagatacattcgtataccacctgcctgttggctttcttcacatcactgagattattccccttcatattccccctcctgtaccggcccaatgctttttacatttttccgtattaccatcatcattatatcttgcccctgcttccagtgtcaatagataaaaggcagccgtttcctctgtataaaacggctgcccaatatcataatcagaatttgtccagctttttttgaatcacctgttttctcttctccccggcctcacacagctgctttttgtgctcctgtatccataacttgtttgcctcaacctctttttttgccctgtcaatcatggacttcatagctttatcaccggttcctcctctgacctccctgcattttacaaaatgccagggattgatacactgggagatgggtgtaaaatcaaaagcaaaaggctctccaaagaactcatgataggcagaagaaaagaattcttcagatatattttttaaattgtaatccatggttcccgcctttttaacaagaaaactaacaaaggaatgggccttcctgaatggtatcttataagagcggtacatttggtcggcaatatcagtaaccacggaaaagctttcataggccctgctctcaagcaattctttgtttacctccagcgtactgataactgcgcggaacaactgcacatttttttggaacagctccaggcagccaaatacactatcctcgatgtcttcataatcagaaatatccccgtacgggctcttcagaaacccggtcagtaccgtatccgccattcccttcagaacagacagagaggaccgcagatgttccaatgcaatgggatttcttttctgaggcataatggagcttatggaaatgtagccgtccgccacatgaatcatattcatttcctgtgttgcccagagaagcaaatccgtaacaatcctgcccatatccaaagcacataatcccagaacactggctgtctccgtcaaataatcactgtttccgatggcatcgtatgcattctcaataatgccggaaaaaccggccagctctgccacccgttctctggaaacaggaaaaccagtggtcgtcactgcggcagcgcccatgggcgactggttcactgcatcataagctctgcacagacgcttaaaatcacgttccagcagatcggcggcgccaagaaaataatgtcccaataatccgggctgcgcatgctgtgtatgggtgtgaatcacatacaaggtatctttatgttcctctgcaaacagcacaacggcatttttcagatacagaaactgttccatggcctgcaaaagaccatcccgcaccgccatgtgggaccatgccacgcacatgtcattgcggctcctggccagatgcagattgcccgcaataccgtctgttgcctcaatcagcctgctttccatataaaaatacaagtcttcataccgcccatcatacaccgtatttttataaaattcctgatccagatctcccagagccttgagaatgacatttccatttttttcatccacaatcccctgctccatcagcatgataagatgggcttcatttattgcctgaatatagggaagcatccggtttttagctctctcataaccaggttccaactccatggcaaccagtgccttccctgggtatttcatcccttcctgttccagcgtctgctttcttaaatccgtatatgtctctggcagcttcatgccccttatgcctcctctttcctcttttcataatatacctactggtctgccacggctccgtcctcccgcagctttgtcacatataaacgcggcttgtatggatatttattcatggctgattcatttaactctattccgattccgggcccctccggcacggtcagacagccgtccttcagagtaagtgtggattttacaatctcatttttaggcgcactgtcctcacccaggggatattcctgaatcgcaaagtttggtatggatgcagccagctggatacaggccgccgtactgaccggactcagcggattatggggcaccaccataactcccctggcttctgccagggctgcaatctttttggcctgtgttattccgccgcacaggcatacatccgggcgtatgtactggcatgcattacgagaaagaagcattccaaattcctctaaggtgtgcagcctttcccctgtggcgacgggaatatgtattctatcagccaccttctccatatcatcaaaattgtcaggtctcaccggatcttcaaaaaacatgggtctggcctgttctatttcccttcccagcgcaattgcttccggtacatttaactgtctgtgtatttcaatgcaaaggtctacctcatttcccaccgcctccctgtattgatagacgcgttcagacgcagtgcttattttagcggcaaagctttcaagaggcatgatttccctgcggtccgaatccacaaagggcgtcagatgccctactgctgtaaatccgcgggctttggcatccctgcatccccggatcagttcttctccggtggagccgaatacatgataatagaccctggccttatgccgtacttttccccccaacagttcatagcatggaacaccgtaatatttaccctttatgtcccacagggcaatatcaatcgctgacagcgctcccatgatagcagctcccctaaagtggtagcaccggtacatatactgccagtggtgctctatcaaaaggggattctgtcctatcagataccgtttgaaggtctccaccaccgcctctgaggcttctaaaaaggcccatgccccggattcgcccacacccgatatgccttcatccgtatccacctgtacaaacatatattgatcaatcaaccgtgtgcttacatctgttatcttcatccttactcctcttatccttttacggaaccgctggtaagacctcccaccagatacttctgggcaaacagcgcaaacaaaaaggaaggtatacatacaatcatggaggctgccagcacatccccctgcagcatgctgtctctggaactaaagtccgcgattaccactggcaatgttttctttgactcatcaattaacagcgtgttggccagcaggaagttattccagatgccgataaacgtcatgatgccgctggccgcaagccctggcaatgccacaggcaggaatatatgccagagtgtctggatttttgccagaccatctatctccgctgcttcaatcaggtctgacgggatggtttcaaaataagactgcatggtccatatacagataggcagttcaaatgcaatgtaacacagaatcagccctttgtatgtgttaatcaatcccatcttggacatcatcagataaataggtatgataattaagatctgcggaaacatatatacaaataataccattttgctgaatgtctctttcatccggtactcatatgccttatagctgaatgcggccaggcatgcaactgccagtgtaagaatggtggaaaccaccgttataaaaatactgttccacaggaaacgggcaattccaaattccgtaaataccttcttcacaaaatacagggagtatgtttgcggaaggatggaaggcggaagcttggttacggtctgaggactttgcagtgccgaaaccaccagccagtatacgggaaatataattggtattaccactgccactgccagaatatgaattccaatcagtttcagaagcttgctgttttttctgttcacatgtccacccccattagccatacagcttatcctgccgcttttttagtatgaaataaattgctgcaaatataattaaaatcacaaatagaatcatggttatggcagatccttctcccattctgtaactgctgaacgctctcctgtatgcgtaaataggagttgtctgtgtggcctcagccggtccgcctcctgtcatgacccacggcaaatcatagaaattaaatgtccatatgaatctcaggattcctgataccatgacaacaggcatcaaaagcggcaatgtaattttggaaaaccgtttccagccatttgccccgtcaatctgtcccgcctcatataagtcagaaggaatcccctgcagtcccgcaaggaacatggttataagcattggcacgccgcgccagacattggccagtataaggataaacatggcggtatgctcattggcaatccacgccacgggttcttttaacacatgcagatccattaatatatagttcatgatcccgtaaatgtcatgaaacatccacctgaatatcatggcaaccgccaccgtgggaaccagccacggcattatcaccagtcctctgaacaaccccttaaaacgcaggtccggatgattcaaaaggatggcaatggccagccctaatacaacctgcggtataagtgagccaaaggtaaagataagcgaccgtcccactgcctgccagaatgaggcatcctgtaatatctttatatagttagtcatcccaacaaaattcatgaccggttttctgacgctgtagcctgtgaaactcattacaagagcatagagcatcggatacaccacaattccaaatataatcagaatagccggcatataaagcaaggttccctgagtgctcgtcctgtttttctttttcctgttaccggacatccggtatccacccccttttagacagagtggatattctgctgtgtctgctcagaatatccactcccaaaatgattataacagtttctccagttcgcccacaatataatccactgcctggtccgcactatacccatctgaaagcatcttaatcaggccattgcccagaatacactgggattcaaactcgccggcgcccgggaacggtccattgaccattcctaatccattggatgttgacagaatatcaagcgccatatccggcaccatctctttcagattgtcaggaaggttatcctggtatttcgtgttctggaagagctcctccttggccgggaacatggcatatggatagctgaggtaaaaatcaaccatgttatcgccggtaaacatatattttacaaaatcctttgccagtgccgtattgccgtcagctgaaatactcagtccaacccatccctgtccggatcctgtcttttttcttccgggtattttaaaataggatacatcatccatatcatcgggggcaacggactgaagtgtatagtaaatttccggagtgtcgatacggctcatcacagtaccgcctgccaccatttccctgacatttgtctgtgtataacccacggttccctccggcgcgcagtccttcactaatttatagaggtagtcataggtttccaccatggcggcccggctttcatcatccaggtcaatataccactcaccattttcatccacatttaaaaggtccacatcattggcctgcaggaaactccaaatcgttttccaggcgtggaggtctcccaaaggcagggcaaaaccatatctgtccttggatgggtctgtcacggccttacacatatcgtaatactcttcccaggttgtgggcaaagtttcgataccggcctctttcagccagctgtccctgtaataagtcacataaggagtgatataaagaggaacagaatataatccatcctcatacgcaccttgaactgataaggatgtacttaaaaatgcatcctttccccctatttcctccacaaggtcagataactccagcagacctcccgtaccagctaaggactggggataaccagttcctgtcaccataatatccggtgcgtttcctgccataatagctgatacgattttgtccatggccccgctccatggcatgactgtaatgttaatctgtgttcccggattctgttccatataagaatctgccagcttctgcagttcatcggccctctcctgctgtgtcagcatggaccacatctcaatggttcctgtcacttcctctgctgattctgcctgggcggaatcagcattctcctcgttggtttctgatgcctttacctcttgtgcatcctttgtaccggagtcagcgctctgtccgcatcccgccgcagccatcatgacggctgctcccataataacccccagtatccgtttcactttctttgtcatttttgtacctcccatcattttttattatttatcatcagaagaatacgtacagtatggacgtattctctcatattcaatctccacgcctaaccccggcgcctgggggaccatgatctgccccaattcgttcagcctgataggattagagaacatatcttttagcagggcatttgtattattgtcgtaatattccgcaatcaggccgttgggaaccgaagccaccagatgagcgtgtatctcttggtctccgtgaggtgccagcagcacatgggacgacatagctaaatcagctaccttcttccactctgtaatgccgcccagcacctgggcatctgcattcagcacctgggctgcatttgactctattaactgtttaaatccccatctggtatactcattctccccaatggcaatgggtatgtccagttttctctgaagctcagcacagccctcgatatcatccggtgataaaggctcctcaaaccagtatatgttcctgcgctccagctcccttcccattttcagagcatctatccggttatatgcattattcgcatccaccagtaaatgtatatccggcccaaccgcatcccgtaccgcgtccacgcgttccaaatcttccttaatagatgcgcctcctattttcatctttacggcctttgctccccgcttcaggttttccttcatttcgctctgaagcatatcccatccttttccttcttcataataaccgcctgctatgtaagccggtatccggtcgacatatcctcccagcatctggcaaacgcttctgcccgccaccttaccttttatgtcccaaagggctatgtcgatgccgctgattgcccgcgtagcaagcccctttcgtccatatactttaggaagatacatccgttcccaaatccgctctacgttaaagggatcctggcctatgacccggtcttttaaactcagcattgcctttatcaccatatctgagccatggacccatccaacaccgtttaccccctcatccgttactacctcgcatattacgatttcagttgcaggatatgtatattttccgttacgaatcggatttttgtaggcagcggaatatgcgtgaatcctgatatctgtaattatcatttcggacctcccatttattatgcattttgtatgttttaccattcttattcctttttctattaacactatatcactacgccgcactttatgtcaataacttttgtaaaatttatttacaaaattattttaaataacttccacagttaaaaatggcaattgtccctgggtttatgctctgcttcgttctgttattgggcggctgttccaatgtacaggggaaaacagcaaaaaaataccgggaagctcagtatcttcccggtacgtttaaatattatattttcattcagacaatttccttatgctttcatgcagcatccccagtcccttttccgtcctctccacatacggcgaatcagcaagatactgttccagtatcagaaggttagcctccgttgcctccacccccagttcccttaaggacagaggcatatccagatgtctcatgaactccttcaagttctccatctcccctcctaggccattatagtgaagctggacaaacagtcccactgccactatttccccgtgaagggcctgccttgcctccctggtaaaacaggttctgattccgtagtatatcatatgggccagggccgactggttaaagctccttgtaatgttagagataatgccagtgaccgcaatgttgatgtaggtgacatactccactgcctttgtcaccgtcccccgccttatatcctctatggcctggtgtccataccgctccagcaaatcataggcaaattcagacatcctgtacgctgtatataagtcaaaggcagccgtatccggctccatggcaggcctgccgttaagcatctctatcttctttgccatggcgtccagtattccggccgccgcgtagcggcaggggcacccggagattacatccaggtccacatataccccgtctgtttcatattcatatctccaattatccttcatggctccctggggcgtatacatgacgctcatggctgtaaaggctgcgcaggtggcaatggaggtagggatattgataacgcctactcccgcttttccggccactgcctttgataagtccatgataacgccgcccccaatgcccaccacttcgtcgcatcccgcgtccagacactttttaccgagggcatccgccgcctcataactgcatacgccgtcataaatctcagcaacaaactccactccggcctctgtaagaccgggaagcagccggtcctttacagcgtcaaaagccttgggaccggacacaatgtaagccttttttccaaaccgccttatctcctgtccgcagtgttccagtacgcccctgccctggcgataccttcctgcaccgaatttgacagcgctgtccatcacattgtttatcccattgcccatcacagtatccacttatacccaatcctcataaatataatccggggcacaatacatgatttgcccgtcctttaccgtcatctcgggtttcagcagtttatccgcggtaaaggcagtccccttccagtccttataggtctgtttgaaatccatccaccggaagatggccacatccgccctggccccttccgacaggcatccaatctctccctgcattttcatcagtccggccgggcgctctgtggccatgctgaccacctggctcatggggattcccatacagatataccgggacatcaggtttggcagtgaaaaaatggggcgtctgaacatgcttcccaacaccaggtccgtactgcacatatccgcaataaatccctgttccttggccttaagcatgacgtcaaaatcaccgtgcttccttccctctgccgtgtcaaagataattccccgtttcctggcctccctgacacagtcgtacaatttgccgttttcatcaatgatcgtgttcttcactccctggtatacatgttcaaagatatctccgggacgcagaaccttaagcacctcactggtgggtaccgggatgttggtgcagtgaacctccaccggacagcctgccatgccggctatacggaccgtttcctttaacggctcaatgcccaatccctctgccagttcttcactctggcgtattttaagacccaggatattgtcctgattatcatggtacatacggacaatcttttccgggttgaaaaatttcggattgatacactcatgatagctggttgtggtcagccctgcggaacacacctgaaggaagctcttgatggtaaccctgctcctggcaatcactgccgacctgaagattggataattggcaacgccggccgaaaaatctatggcagacgtaactcctgtgggcagataggccacatccggatatatgccgatctccgttccttcctggaacatatgggcatgggcgtcaatcagtccgggaaaaacatatcttcccgcggcgtccaccacatgccttgccggctccccttcctcatatctggtgattctgccgttataaatcgctatgtttcctacctgatcggtccggttggccgggtcaatcacatgtccgttcttaatcaataaatctaacattctaccacctccgggtatcttaccaaagaccaatgagtttccaataaggaaggccaatcaaaaagaaaataacaagggccattgccaccatgatggtgcccactctccagaagtccttctggggcacatagtccgacgcaaaggttataaggccggctccgtttccataatgggtaaggagggctccaaagctggcgaaaaatgcaagcagcagtcccaccaccatggggtttgcctttgtattcactgcaagagagaacagcaccggataaaaggatgccacaaacgcgctgttggaaacaaagaaatagcgcaccgccaggctgaccagcaccagaatcacggttactgccatgccgttcatctgggaaagatccagcacaacacccagctggtctgccagccatgtataaaatccggctgatgacagggctgaggcaatgccatagaaagcgccgtaccagataaagatactccaggcccctttggcggccattacatcgttccagtccagcacgtccagaagcagaacaagtgccaggaacacaaagcccaccacctgcatgctcaggttgacaaccggaagcttcggtccgaacatccatcccagaatggcaaggaggaacaggacaaacagtttcttctcagcagacgtaacagctcccagctcctttaaccccttttgcgcaagcggcttgatgtcatccagggatttgagttccggcggatagattttgtaaatcacatagggagccagcagcaaaaacaggcctaccggtacaatggatgccagaaaccaggttccccaggtaagggtaattcccaacatctcggtaatcagggacacggttatggcattggtggccataccggtcaggaacaaggctgatgttccctgagagcttgcgtacatgagtacggtcagataggcgcccagctttctgggtgcattcttggcgcttgaaccggtgccctccgcaatattctggaaaatgggataaataatacttgtcctggaagagttggaaccggttgccgggcttaatacaaggtctgtaaataccataatgtagcccagactcagggtattcttgccggacttaagcagcaggttataggcaatacgcctgcccagccccgtctttacaaacgcagtacagacaatggttaccatagcgataaaccatgccatattattcccgtatccctttaacaggatggatgtatccatgaacatggctgcaatgcctacgataatcagagtaatgatcggctctgaaaatggtttgattaccagtcccagcagcagccccaggtacagcgccacaatatgccaggtctccacttccaatccggccggcgccggtatgttccagatagcaattgttacggcagctatgaggaatagttttaaaaaccgtttcttttccatatatatcctccatatgttccaatcagccggcagtttctaccggcgtttccttctgttaaaaaacacaaaaccagtcacggcaaacccaatcatcatgacaaaacccacaccgaatgtcagggcgattccgttcatgagccacacaggcgtcaggcccacgtatatatccttccatgacatgatggtggaatagacaccatgggtatctcccgcccctgactgggagtccggatcgattgcgcgcaccagggccagcccggtggatgtgttgccggtggcagccccaaaggccatacatgccttttcaaaccattcatccttacagaaacggtaagacaagtaaaaaatcagggggaccgtcaatccgcagatagtaaccgtatatatcaggacaggcacaatataggtagagacaaactccagattcagtgttgccatggctgtaaacaccacgatttccagaaagaatccgctgagcatcttaactgtctttatgtccacataccggtccagtttcgtcatcttaagtatcttccacaggatggctcctccaaacacgccgtggagtacacccggtaattttgtaaaaaagggaatgaaggttccaaggaaatggaaaatggtccttcccagaaacagtgctgccagcagccatgatatctgaagcgccagatggttgatgctgatggcggttgtcactgtatggccggaagcagcccgtttttcctggggcagagtcccgccgtaaaaataggaaggctgtttctttggctcctttacatatgtaccccatccttttctgatcccgtaattgaccatggccattcccacaaccatggcaaatataaggccaaaggtagacagcaccattcccactgccatgttgccgtccacgcccagcttctgaaaagcagacgccgtggcagcggctgttccgtggccgccatggaatgagaaaacgcccatgacgccccatccctggggaagtccggtccatatctttgacagaatccagcccaggcctacacccaggcacatctgcatcccgtaggaggtcatggtaacacaggagtaatccagataggaactgatcttctcccggttgaaattaaccccgaacacaagggacgccatgacaatgtcaatgagcacgccgggcagttcatggaagctttccggcaccgcaatgatacccatggcctgatggcccaggagaagcagaagcagtccgccaatcagggacgagggcaggaacagcttctgaaccggcttaaagatctcccggatgaaaaaaccagccagcataaaaaccgccaatattaacatatcattgcataaagatgacactgtcatgataaatcccccgtttttcttttctgtcttctcctgtaatttcaagctctattatagcatgaaactctgtcctgccatgatttaaaagtcaaacataccggaacttttcttatttggctttttcgtatctgtataagtcggtgcagtcacataatcaatatcattgattggccaggtaggttctttcccctcatagacctcctgtacgcccatggctgcaaaataagacgccctgtgcgctgcctccattgtgtttcctccaatgtgtgggtaaatgattacattgtccagggtcagaagagggttggcaggatccaccggctccttctggatggcatccagtcccgcacctgcaatggttttattcttacatgcctcgtacagatcctgctccacaacacagccgccccttgccgtattaatcaggaaagcggtcggcttcatcatttccagacgctccttgtttaccataccgcgggtaattggggtattcggaacatgcagggaaacgtaatcgctctccttgaaaatccgatccaggtccctgaccacctcaactccctccgggaattcatctgctttcttatatgggtcataggccaggacattcatttccatgccaagcgcacgcacggccagacggcttccgatatttccgcatccgatgatacccactgtcttgccgtttactgtcgtctttctggtcttaagctttgccttgtagtaatcctgaacccatattttcctcagttcaatcacattgcggctgcattccagcatcagaagcatggctgtctctgccactgaggtgctgtttgccaccggcgcatacagggtctgtaccccgttgtcatggcatgcctttacatccagtgcgtcaaatcctgcgccgtggcgtaccaccaccttcagattggggttggcctcgattacttccctggtgattggcgtaatacgcacaatcattgcatccggcttgtgctccttcatatcagccagcacgtcctctgtctcaaagccgcgtcccctaatcagggtatgtcctgcatccactaataactgctcaccttcatccatgatttcctgtggtaataaaatcttccatcccatgttcttatctctccctgtgatttttttataatgtgtgatttacatttatatacgtaaggttttgggcaccaaatcaatttacaattgattatggcctgtaaacatcgtcaataatttcaaatccctttgcctccagcgccttgtccacccactcacgtttggctgtgccgtttttggaagcttccagcttggcctcatctgctgcctggaatttcctggcttcctccagaatgaccgctgcgtccttgcgcggaatgacgatgacaccgtccggatctgccaggatgatgtctcccgggttcacactgattcctccgcaggctattggtacattgacctcgcccggtccctccttgtaaggaccgcccggggtggttcccgtacagtaaaccgggaaatcccatttgccaatctcgtcgatgtcgcggattggaccgtccagaataatgcccgccaccttctttgtataccgcagatatgccatcatgacctcgccaatcagggctcttgtactgtcctcctcattggaaaccacaatcacatctccctcattgcacatgctgagggctgcgtgcagggccagattgtcacccgctctgcatttaaccgtgtaggcaggtcccaccatcatctgcgcctttggactgctgaccagacggatgcgcgggttcatggcacagctccttcccatgacatccgctgtgttggaggccggtatggacttaaactggttcattacctccatgtctggcatctctctttttagataaatacgtttccctactgacataacattaccttcctttcttaccaaacacttgactccttgcgagtttttttgttgtaattttccttaaaaccatttgctctcctgataattttattgtaatatataactaatcacaaatcaaacaatgtattttcaagtttttaacaaaataaatttgtggaggttaaaatcatggatacactaagcctgtattacttctcggagcttgccaaggatctgcacatcacccgcactgccaaccgtttatttatatcccagcagacactgagcaaccatatcatgagactggaggaatattacggggtaaagctgctgaaccgtaagccctccctctcccttacatatgccggagagtatgtactgtcatttgcagagaccatgaaccgtgaaaacgcaaaccttatggatattctggcagatatccagaagcagaaacggggccttatcctgttcggcgccagcaccctgcgcatgagcgccagcctgcctgatatcctgcctgagttctcatcccggtatcccaatgtggaaatccgtatcaccgacatgaactccaagcggctggagcagttgattctgagcggagacctggacctggccatcgtcatatccgggggcgaacatcccagtatagaggaaaaacccctgatgtccgaccagatttacctttgtgctgccgatacgctgcttcggaaatattatggcgacgggacagaggatttaaaacgaaaggcccgaaacatggcggatgtaaaagatttctccaggctgcctttttgtattctcaataaccgcatgggtcagaatatccagaaatgctttgacgaggccggatttgtccccaacatttacaccaccagcgcctatgtgcagatcagcacatccatcggcctaaaaggccttgccgcatgcttcgccacccgcaacagcatattgaaccagaagggtgaaatctctgaggatatcaatgtatttccgctgtactgcaagggagagcccctccttcagcagatatccgtgattcatcacaaggaccgctatctctccacctatacgcagtattttcaggaactgatactaaaatatttccatgaggttgagcagattccgattgaggaactggtaaactcgtcctctatttcactgcagtaaaaacaccaggcgtttccctgctctgtttgaaccgggaaatgcctggcgcttactagtccaatttaaatagtatccggcgcatctacaaaccaaataccctgcgccccgttatcccggctgtgccagcaggcaccttccaatggtccgcctgcgatggagtcgaagtaataccaatcgccggaaccgtcttccgggtcgcacacgctaccattccagcgatgccagctggtacaggcatatccgtctttattaaaaaggtaccaatgatggttaatagtatgccatgcgttggctggataactgccgtccggccggcggtaccaccagccgttattgtcctttatccagccagtacgttcttccgggatccaggttttcatgaacgcctccggagtggcgtatacctttttgattccactggtggaacttccccagtccggcagctggcaatggggattatccataatggatttccagttcccgccccattccaggcccagggacatgccgatggcgccaacccgctggaagaatagagcagaatcattataagctccagccccatcatttctgaaaatatcaaatgctgtcccccactgatgataggagctgtagttgctgcctggggcgttggttactatattccccggttccgtcctgccttgggcatacagggcgtcctgctccgccacagtacgaaatgtctcgcctattttaatactcaacccctgtctgccgcactcctctattaactgaccggccagatgctgcaggcggggatggcataatgtaatgtctctcatagcagacctcctaatcatatatattatgaactatggcccagggatgcccctgagccatgaaaagttatgacgtctagtccaaatatgaccggactcgtcatagattactctgctttcgccttaaggaaattgaaccggaccagcctatataaactgtccgtccttctacgataagatatttagttccctccgcatataaaacctgcatgataacaaaacaaataaaactgcatgcggcttggcattaaagtatcgttaatattcctcccatcccgttgacattatccctttatcctcatataattccagcaggacaggatatttccatatataaaaacatcagaagggaaatgacatacatatggacgccaccgtcaacgacgatgaccaaattttcacccaaaaaccacgcttcatatgtttaaaagaaaaggcataacccgcattcatacacatggatgcgggcaatgcctttttcttttgaaataatactgccaaacagataaaagaggaggaatcattgtgagtattcattcgtttttcagtctattaggagggctggcattatttttgtacggcatgcagatgatgagcaccaatctggaagccgcagccggaagccgcatgaagcagattctggagcggctgactgccaaccggtttttaggcgtgttcgtgggagccggaatcactgctatcatccagtcctcatccgccacaaccgtcatggtggtgggcttcgtcaactcccagctcatgacactcaaacaggctgtctggatcatcatgggcgccaatatcggaaccaccgtgaccggccagctcatagccctggacatcggggccgtcgcgccgttgattgcatttgcaggtgttgccctgattctttttgtcaaacagaaaaaggtccagtttgccggtggtattattgcaggtctgggtatcctctttctcggcatgggaatgatgagcgccgcaatgatacccctgcgcgattcccagcattttgtcaatttgatgacaaagttttccaatccctttctgggtattctggccggagcagcttttactgctatcatacagtcctcttctgcatctgttggtatccttcaggctttggctgtaagcggattaatcggactggacagcgctgtctttgtcctgttcggccagaatatcggcacctgcatcacggcagtcctggcctctatcggggcaaaccgcgacgcgaaacggaccaccctgattcacctgatattcaatgtcattggcacaactgtgtttaccctgatctgcctggtgtccccctttacacagtggatggcctcgttcacaccggacaatcccgcggcgcagattgccaatgtacatacactgtttaacattgtcacaaccctgcttctgctgcctttcggcacacagcttgcacggatatccgaaaagcttctgcctgataagccgcagaaaacaacggatgaggagcgctggtttgaggatttgctggcctccgaacatgtacttggcgtatcagtcatagcaaggaagcagctgaatgaggacatcagccggatgcttgctctggcgtcctccaatgttgaaaccagttttctggcttttgagcacagggatgaatacgaactggagcagattcaaaaacgtgaggaagagattgatctttacaatgcccagttatccagaaggatttccagggtccttgcagtggaaaattccccgtctgaagtaaatgcgcttaaccgcatgttctccatcatcggaaatgtggagcgcatcggcgaccatgcaacaaatattgccggctatgcccggaccatgatggagcgcaggctggagctttcatcccaggcatctgttgaactggctgatatgaggacctcctgcatgcgcgccgtacacctgatttgcagcgcctgctgtgttaatttcacatttgctccagagcaggaatctccagataaacgcggatctctgacggagcatgacgctccggcagaacatatatccttaccgcagcacgcctcccttctggaacaggccctgctgctggaacaagacattgacagccggaccgcccggtaccgctccaaccagattgaacgcatgcgaaaggggaaatgccatgtggagacttccatcctgtattcggaaatcctgaccgattatgagcgcattggcgaccatgcgttcaacattgcccaggcacttgacaagctggatgaaaattaacttgcagattcgtttcccgcagcagtcactaagcttccggcggcaatgcctgcttcttccgccgttttttatgttcctgaagataaaatgattgaacgcaggtcaacgaacaaagtcattgaaaaaaaacgtattgctatgctataatcaatgcatccatatagggcggggcagttcataccatcaggtataaaagtcaatcagaatataactggttagaactggaatagtaagcctatacacacttaaaatgtgtgcatgggcttttatatttgcagaaaggcgttacaaacaatgatcagcatagtaactacatctattgtttcatttatcagtaccaacatagataatatttttgtcatgatggtgctctatgccagggttgacgaaacttttaaaaagaaatatgttgtcattgggcaatatcttgctattggcatactgacagcaataagcctgtcagctgctttcggcctcaactttgttccgcaaaaatacgtcggtctgttcggttttataccgattgctttaggcgtcaaagaatggatatcatacaaacgacctgcccaaaacaaatccaatcgtaaagaatttccgttggaaacagaaaaaaccgaggctgcccaccccaacaagctgcagaatatattgcggaaagtaacatctatggccagtaaaatcgtaaatcctgaaattttaagcgttgctctcgtaggcgtggcaaatggagctgataatattggcgtttatattccgttgtttaccggctattcatcaatacaggtcattgtaactatcatagtgtttgttttaatgatggcggtttggtgcttcctgggagaaaagataaccgatttccccaagataaaagcaatcattcaaacgtataagtattttgccgtaccggttgtctttgttggacttggtatatacatcattatcaaaagcgggttaatagcgtgataaaaacagttttatacctgattgtaaaataacggttccggacggagaagctccggttaaaacttaccgggataaactgtacaaaaaacaggaaacggctccgcatccgtatagataaaaaaaatagccggctgtttccttatagaaaaaataaatgccgggcctgcaaaggggcaaaagcgtttgcatacactttcaaacctgctataattagagacatgtgatgataatttcaaagcacacttccgggaataggaagaatcagatacatgtttaaggaggatacgaactatgaaattagatgaacgcggaaaacagtgccccaagcctgtcattgacactaagaaagcgttggaatcctgcaatccgggagagacggttgaggtattggtagacaatgagattgcggtccagaacctgagcaagatggctgccagcaaaggcctttcagctgtttccgagaaaataagcgacaatgaattttccgtaaaaatcccagttggccagggagtaaccccggcttccggtgcgccggatgattcggatgaggaaccggcggcctgcctgcctgacagccgcaaaaagggcatggcagtggttctgtcctccaaccttatgggccacggtgaccctgaacttggaaaggctctcatgaaagggtttgtctacgcccttacacagcaggatgtcctgccggagaccattcttctgtataacagcggcgcctatctttcctgcgaaggctctgataacctggaggatttaaaatccatggaatcccagggcgtagagattctcacctgcggaacctgcctgaatttctatggattgagcgagaagcttcaggtcggcagcgtcaccaatatgtatgagattgtggaacgcatgacagccgccaaacttctggtgcgtccttaagctttcctgacagccggactgacaaaaagattataataccgcaaaaggacccctgcatctcatttcagggtcctttttcatatgcttacctgctcagacctgattcatacctgttcaaggcatcctcagacatcagccaggattccggtcacactcagccaactccgataaatattgtccttaaacaccgccccatccctgatgaccggcagattgcatatacacctcccgcctgctgtccgggacaccattccatctctcatagcacctctcattccggctttcatcccggctttccatcccccgttcatcccatcctcctccattctcagatatcctgtctccaggtcctgttccgacacacacaggcattttacattatccgcaaataattccggatgcataagataagccgctgccgtcacatcccagttatagaaaccgtgaatgccgtagccctcatcattatatctgaaccaatcatctgttttttccataatatacgctgccgccctgttttccttttctgagaaccgttccctgtattcctgttttgtaaacaaaactttaaggcagttgttgcctgttatcacggaaatattccggccctttgtgaggacggtcctggcagccggcgggtcacaggaaaaattcagttcatccatcaccttcttttcaaatacaagggggcttgtgattccgcccattaagacaatttcttttaccttttcaaagaaatgactgtcccgctcatatgcgcctttcaggtttgtcagagaacccgtggcaagaatcgacagctcccccggatggcggtccgccatttccgccagaaagacggcagcctcgctctggtaacagcccctcttctccccgcctctttttacaggaatatccctgcgccccaattcttccagcatccgcagattcgctgcctgcaccacatccaggctgctgtttccataggtggacgtaatccccagaagttgggcctccctgcttcccagcaaatacatcagggccagcccgtcatccacatcgcagtcctttactccaaaggtattgtcacagtcaaatatgattttcttcatctgcatctcctcccgtccatgttttcccggcacagtcccctcctggacacagtcccctcctggacacaatccccgccgcagcacataactcgccaccacataccgtttccggccccatatccctcattccatatcatgcctgaacagcacggccccttccgtttccacggccagtccggccttcatacctgcccgtaattttaccggccagccggggccttccattctctggcacaggatgcttccgccgggagccattttctcaggcaccctcacccttatctctgtcatctcccccatgaaggtaacttcctccaccgtataatcaccctcctctttcagctgtactgagttcggacgaatcatggcgtcatagaccccatccggcaaatccgttcttttttcaaacaaagagctgacaaaccggcctcctgccactgacccggaaatataatttacctttccaaagtactctgccaccttttttgtttccggatggcagaacatctgctccggagttccgtactgaagaatcttcccatcctccatcaatgctatgcggtcggacaagcgaagggcctcagccttgtcgtgagtgacgagaatagttgtgattttccacgcctcatgaagttttcttaccagccgcgccatctctgtcctcagcccctcatccaggccggaaaagggttcgtccagaagcagcaccctaggttctgctgccaaagccctggccagggctactctctgcctctggccccctgacatctccttcatccttctcttctcaaatccaggaagctgaaccgcccgcagcagtgcctccacccgctccttctgctcttttttcggcacctttctgagttccatgggaaaggcaatgtttttctccgccgtcatatggggaaacagccgcaaatcctgaaacacgattaccgttcccctctcttttggctgctgttccatcacagatgctccctgtatccgtatatccccgctctcctgctccaaaagacctgctatgcattttaacagagtggtctttccgcagccggattttcccaagagagatacaaactctccctcctgtatttccaggtcgattccatgcagtatcttctttttctgaagggataccctcagattttctatgttaagactcataatatcctccaaccatctgtccggtccaataccccgcaatccgttcaaacacagcaaataccagcaaagtgatgcccatgaacaaaatgctgtaaacgcaggcaatattccggctgccgctctgtaaatagggaaccattacaaccgcaaaggtctttaccctgccgcctccaagaagcagtgtcagaaaatactggctgaaggatacaatgtatgacatgctgactgccgacaatatcaccggaaccagcattggcagtgtggtccttctgaatgcctgaaaggaacccgcccccagcacccgggcctgctcctccagtccaatgcccactgcccgggtgccgtccataataaggcacaccgcgtagggcagggaataaatcaggtgtgccagaatgacccccgccactgtattgttaagtcccaaccggataaacgtaatttgtatccccatggcaaacacagttccaggtaccatgagaggaagcacggtaagaaatgacatcaattccttccccctgaaccggtacaggacaagggccctggatgtcagtatcccgatgacggccgccaggacggccaccacagaagaaatcatgacgctggatgccatgagtgagaccagttctccctttcttctgacaatttccatgacggcccggtccgagagcacctggggatacaaatctggccaggcccaccgttccgtaaatacccatacaaccagactggccgcgggaatcagaatggatgcacacagcagggccagaatcatatttgtgataaacgattttctcttcttcatctctgtccgctccaacttctactgctctgtcagtgccttcatatttttacgcatgatgaaataataaatccaggcgctgagcacggagagaacgataatgattccatttaacgccatggaataaggccggtttctcaaatccggatgaatatactgctggtatgccagcaccggaagggcttttggggaggttgcacccagaagaaagggaagttcataggcgcccagggcaaatacaaatataatcaggaacccgctgattaccgcatccttacaaagcggcagggtgattttacaaaaagcagtccaccggcccgcccccaggtttatggctgcttctcccagtttctcattgatatttgccatcagagcaataacaaaataaattataaagggaatctccttccacagatatgccaggatgactcccacaccctttgtgtcataaatgagcatgggaaactgctgctgttcctgtaataatccaagggcgtaacccattctggccagcagaccattctgtgaaaagatgttgaccataaaaatagccactaccacatggggaacaatgatgggcagctgtatcacccgcatcatgggcccctttgtctttttgtgcatcacacataccgcacttaaacccacgcctgccgcagtggcaacacccgcagacagaaatgccaccttaaggctgtacagcacggactttaacatttccggcctggccagcacttcccggtagtattttaaggttggttccctcaatccaaaagctggaattaccccaagactttgggtaattccagttgtcaatcctatgataaaaaacagggttactatgatttggggaaccagaagtaaatacggaatcagatttcttctcatttttttccttctcatatctttcccaccactccgttcccacccattctgttccctctccatccgtcctctcttatgctgttcccttgcattacgttcccttccactccgattccacccatccgattctcccccgttatttacccactacttcctcagcccagatttcctcgataatgggaaccagctgtgcaggcatttcgggaaggcgtttagagagaagttcatcctgggggattgcacctttgcccagatccaccctgtcaaaggccgctttctgctcaccggacagcttttcgttgtccagaaccggaatgaccctcagcttttcatagcggtctgcctggatctccggcgatatcatctcgttaattgccaccatggccccggccttattgccggaattagccgcaattgccataaaattggtattaccgatggttcccttttcaaactggaaggctgccgtggtatccgtgtatttgccgtcctcaatgttcagagccacgtcataggctccgtatgtcatgctcatcaccagttccccgtccgcaaacatgttgtccgcggtagtggaggaatccgggaaggcagcgccctgattccaaaggtacggattcagctcccttaagtactccatggccggcgccactgccgcccggacagtttccttatcagccgccatatccataaactgctcgctgccgcagatttcatagataatatttctcacaaacgcgctgcccgtaaaatcaggaagcgcgggatatgtcaccttgcccggatttttttccacgaattccttcagctctccggcgctctctggcacatccggtgtcactgccaggtctgccaccatgaccagctgggcctttccgtagggcgcctcatacccttcgatgggataagcaaagtccatggtcacgtcctcgctttccccatccacatagtcactaaaatttggaagcttgtctgtaaaggggccgtacagcatattgttttcctttgccgacctaaagttctccccgttaatccaaatcatatcaatacttccgtccttctctcccgcctgaatctccccggtgagctggcttaaaacctggtcgatatccatggggacacgttccattgtgatatcgtatttttccttcatgacccgcgcaaattcatcgtccagccaccggttcagtttttcatccccgccccagccgtagaaggtgaccgttgttccctttgcctcctccttcatctggtcaaaggtcatattctccagtccggaccggcggctgtctgtatccccggcctggctgcttccggtatccccggcctggcggcctccggcatcctcagcctgactgcttccggcgccctgtgtctgtccgctgcccgaacacgctccaagggacaacgtcattgcggcagccaataccgctgccgtgattcttttcttcatactttctcctccgctgttttccttaaaaataataaccctgtctgatgattttatgattccccctgccgtaatcttatgcagtacggacaggagaaatcacatcaccggaagggttatcctattctgtcacaaatgcagcctggatatccttatcctttgcgccattttcaatgataaacagattatcaacatcgaatccggcatccttcataacggaaataccagttttagcacacttgttgccgctgtagcaaagcaggtatacaggtttggacgggtccatctcctcctttgccatcttgtacatggcagtctgtgcggccgggtcctcgatttcctttagggagctctggatggatccctttaaatggccttttgcatatgtatcattgtctcggacatccaggatttgaatatcgcttcctcccactgcctttaaggcatctgccgccgcaaccgtcttccagtcaatatcctcgtcggcacggttggtggtaagggcgcctttctcagactccagggctttggcaccgccttccacagtataaatcagggaaccgtcaatgcctgcctccttaaggacaccggttgccttctcagcgcctctcttgccgctgttgcagatgatatagattttctgtccgtcgcttaagttctcctttgcatatgtacccatggcctctgccagggagtcatcctccagcgggaaaatagggcaccacatggaatcagccactcttcccttaacatagttatcccattcccttacatccagcacatgggcactcttatcttttgccgccgccacagcctcctttggggatacatactgataactgccatctgactgtgctgccgctgccgtctcacttgctgctccatccgctcctgttgtatctgcggccgtggtatcctctactgtggagtctgcggctgcggtatctgccgccgtactctcagccgtttcctgggctgttgtttcatttcctgctttctggccgcatccggccgccactgtcatggacagcgccatcataattcctaatgttacgaatttctttttcatttcttcctccttgtttttccttgtttttctatatatattttccttaccatgacaacaaaggcagataaggcaaataatatcattaggccggtgacaaagaacctggcgccgccggtcagcattcctcccacataggaatatacaatggttgccggaagctgtccgattcccgtggccataaaaaatgacagaaagggcatggatgtaagccctgccccgtaactcacaatgtcaaaggacacaaaaggcagaagcctgcaaatcagtattgtatttttgccgtatctgtcaaaaaaagtgtctatctgtttaagccccgccttgctggtcagcttttccgccgcatcccttcccagtatccttgctatgtaaaagcaaagagccgcgcctgccatggcactggaccaggacagaattgccccctgccaccacccaaagagatttgcgttggcaaaggtgatgaggaaggccggaagaggcgccatgacagactgcagcaccatcagtccaaaggataccgccgcagcatagcttccgtaggaagccacaaattccctgaccaccccaaagtctccggcggcaaacatggtcacaattttgttcatcatattttttacagatggtatgcacatatagctcagtatggacgcggctatgcatgcggccaccacggttttccatatccatttactctgttttttctccatttatattcctttcctacagcctgtccattttctctaaaaatcccatgtccagatactgccccagcttttggaatgtggactggttaaacagcagcttgtccggctgctggtactgcacccaggccatggcgcaccaggtaatgccgcgcaggcaggtgatgggaatataggcaagggtacgctccatcagcccctttgtgtcaaatctgccgtccaccttctggatatacagatgaatgaagttctccatctcctccggagtcagaatcacatctgttttccagaaggtggtggtgggcgcaagaaaatggcccagatcctgggcaggttccccatagacaggcttctcccagtccaccaggtagtttccctttccctctccgttgatgagaaaattggtggaattaagctccgtgttgatgcagcattcatagcctttgcaggcagctgcttcccggcagcgcttccagccccggtccagcatctgtcttattttcattttgatgtcccggttccccaggtctgaatccatgtatgttccgaccatggcctcgcattctgtcaggattgcctccaagggatcccccggcctaaccagatggctgtggtttcctaccctgacactgtggatgtccgccagacactctgacccaaaggacagctctgtcctgtaatccatggcgtgacccggcaggaattccattaccatgattccatgaggaattttctccagactcccgtccgcataaaaaggccgcggtgtcctgcccgactgccgcagcagctttagtgtttcatattcgtactgtatctgatgttccaaatgcatctggctgccgcagtttacgcgcagcaccagctttcttccggtaacaggatgcgtaaacaggtaattcctgttgtactccccctgggccagcatacggtattcctccgtcacctggtccggcagtcccagcgcgctgcggtactgcttccaggccacatattcccttaacccggctatccgttccatttcatgtcacctcacatcccggtacatccggtcaatctgttcaatgggcacctgatcccggtacatcttacgcagccggttcatgttccacatcagcttaagcttgggcagggttccttttgggaaacgcctgtccgatgtgtagatgcgccgtcctgtcatgcccagctttactcccctctctttaagcgtcagggaaaactggtaatcctccattacaggaatctccgggaacatgcctgcatcaaaaaacaggctgcggtccacaaagatgccctggtccccaaacatgaccctgcggtccttaatccggtggtttgatatcacacggcaggtaaacatgaagaaattggacgaatgaaaggcaattccaaagcatcccgcgctgtggtccttcatcaccctgcgtatctcggccagcggacggggaggcagttcactgtcgcagtggaggaaaaacaggatgtccccatggctttccatggctcccgtattcatctgcctggcccgtcccttttccgaatgtatgactttaacccaggggcgaatccgttccatggtcctgtccgtgctgccgccgtctacaaacagtatttcacattttcccctcagcggctccagctggtcctgcatctgaacaatggtcttctcctcattgtaaacaggtacaatgatggaaatgcggctggttctggccagataccgtcccgtggacgtctcctgcagcctcttatcctcccgcattctctgccggtatccctgcagatcctggtaaacgtccatatcccacagggtttcggttaatcccaccctgcagccagccgtcttaagccggtacatggtatcccgaagcacggatccctgtccatacccttccacatcaaacacagcccgctgcggtttcttcatgcccaccagataataccccccatccctggtagggcccagaaccacatcgttttgttcaagcaggccaaacgcccgttccagatactccgatctcacttcaggtacatcggttcccatgaggatgcatgcgtcatacccccggcccagaacctcccggacggcctgatacatccgttctcccaggccgctgcctctctgggaaatgtaatactcccctctgccaaaaaccggatataaacgttctctgccctcatccggtgtaaagcatacaaaaagcttcccctccacctttccgcattccctctttatatcttccaggaaacaggtgtggagacgggcgcagcccttggcgctgagcgcgggcatcatcctggtttttgtctgcccaggttcagggacccttgtaaaaataataatcgcacgtttcatctataagattctctccattttccgtcttgccaaaccatcaccaaaactttgtaagcatccggttgaccatagatttcccgatatccggcttctcatcacatcccagaatctcaggcagcaggtgcgtgactccccggcagccgccccgcgtaagatttccggcgcaggacgcacagtaggtaaatacagtcccgtggccctggtccgccacccggtccgtcatcccgcgggccagttccggctccctgcctcccgcgcaccctcccaggccgcagcactggacgccatgcacagtctcaggcatattccttagaaatggagacagccatttcacccactgttttctctccctgtcagggcatggaagaaacagcgccccgctgccttccagccggccccccattcccagccgggataatttctcataaatgctgatgacgtttacctccagcttatccttcaggaactcataacagttgggacagagcattacggcctcttgggcccctgcctcacgaagattatcatttatcctccgggtgatttccgcctcatccctctttagtccaagctctgccaccggttttccgcagcagtcaaacaggactcccatatcgtccttttcttccagcatactgattagtttcctggtggtctttggataaaaggaaggaaaattacaccccgggaacagaatgcttctgccggacaggcgccgtttattgcggtaaatgtaattccgcttttccgccaaaaccatggcataccctttttccgggcattttccctggttttcctccaccctttcccggcgcatttccaggacggcagccctgccgtcaattcccatcgggcaaacctgggtgcaggttccgcacagaaaacagtgatacgccaattccttaagctctgccgtgtcaccgatatcaaggccgtacttacttaaaaaagagcagttttcccggcatatacggcagtgtatgcatttatcgctgtcttttatcctgaatttcccgttcatcctccaacctttcctctgattcctgcagtacataccgtttcttaaagaaaacgcccaggccaatgacagctgaagccagcacaaccgtgatgaagaaataaagaacccggttctccctgtgggccaggcccgcggttcccactgtgtacatggctgttccgggcagcatgaatacgaaggaatagacagaataggtccaaaaggggatgtccgtgactccataggcgaaattctgaagattatagggaaacagcggaaccagccttgtaatcatcaaaacaaacaattcattatttcccgactcgtcaaacagccattttttcaggtatttattcctcataacaacaggcttgatactgtccttcaggaaaaaacgccctgccagaaaggctgccatggctcccagagtagctgccacggtacaacaaacggttcccagcaccgggccgaacagcaggcctgccaggatggcaaatgtaactcccggcagcgtgagcaccacacagcctatcactgtaactgctgtgtacgcaagaatcgcagccgccatatgctcctgtgccatccttcccagaaactccaggatgtccttgcctcctgcccgggatgaccaatcgaatatatggttgcagaccactgccgtcaggatgagcccggcaaataataccggctttatattctgcattttattctgttttttattcttttttttattccaaatcgcggtccggtcatccattcctgcaccccaacattccaatccatgctttggcacactgtatcagggacacagtccccaatattgggctgataaaataataagcccgaaacccgtctgtggaattcatccatgtaaataccgcatacccggatgtcagaagcaccataccggcgttcacagcccacagtgcttttgtcagattccttctccggcgcaggaaacagagaagaagcatggcggtcaggaggaccatcacaagcgcggccccttttgccagcagttccatgggatatctggactcccatcccctgtttttatatacaacataccgggccattcccatttttgtgcgggtaaagaactgtacggcccaggcccctgccagacacaggacttccagaattgtcgcagatatatatgccgctttcttcattatcattttcccttttacatttaataagcgttggctcaatcaagacgcaacgcttatttttatcaatcattattttttagctttgtctgtggacagctcacctaccgtggtaaactggcagctgctttccgcaggatcccccacctgtaccggaagggaatcatccatctgccactggtaccaccctccgtcatacacggtcatattggtcattccgttttcatagcaaatcaggaacggaatagtggccctccagcctgtgccgcagtaaaaggacagctcattgtcaagggaagcgccggattcctccagatagcccttcaatacatccaggcctgctgtggttccgtcctcgttatgataggaaccgtcatccgtatcatgtccccatacagcaccttccggttcgcccgccctgtcaatatatccgtatccgcttgttcttcccaggaactcgtccctgctgcggatgctgaccagcttaaagttatcgtctcctgccagcttttcctttgcctcgccgatggacaggatgtattcgggatgcgccgggatatccacgccgaactccctgtcagagggctgcggggtattaacggttttctctgtctcgtatccgctcttaagccatgcatcataaccgccgtccaggcattttacattctccacccctgcccataaaagggtaaatgccacacggtcgtccgctgaattcgtgcccttatcactatagcagataaccgttgtatcttttgtgattccgtattcagccatcagatcctttatctcttccggagtccggatattccagtactcctccgattcaatatcatccgtattcatgtggtaggcgcctttgatgtggccttccttataagccgccgcatcctggaccgtaccccaggcacattccagaaccatataatcctctgattcttcctgattcccgtccagaacactctgaacccagtccggcgacacatagaccttcttcttttcaaccggagctgcctttactgcagatgcatccgcagcccttgacacatctgtaccagaggaacatcctgctgccaataatacggcggcgcaaatcgcaatgcctaaccatcttcttttcataatccttctccactcccaaatttatattgatgtatctgttatgctgcacatcttatattaccttgattattataaaaacacctgcttgttttgtccaatcggtgaaatatatgcgtttattgatatgtatcgtttttttctatatgaggcttcacggatgttgttcttctatgattcatttcaataattccgccctatcccgtaccaaaaaaatcccctggtccatactacaaaccagaggattacatcaacacaaatcattacggcatttttatatcagctcaaacagtaagatatactcacagtgaaaccttatacccggaaggcgcttccgccttccgcaccttcccctaaagctccgtcctccctctgcatccttctaaaaatgcgggccagcataatgacagaggcaatggaaagcaccagctccgccaccagctgggcataggaaagaccgtacagcgggaacaggctgtttaacaggtacagggccggaatctccagcacaattttacgcagtatggcaaagctcagcgctgccttacccatgccaactgcctggaaaacccctactgccagaaaatccatgcacaggaacggaagtcccaggcagaacccccggaggaaccttgtgccgtaagccacaatcgcttcattgtccataaacgcccttgtaagcacacccgccccggcaaaataccccagggataccaccaccaggaacggcagcagggtcttgatggtaaagaatatggtttccttcattctcctgtggttgccgctggcatagttatagctgataaggggcatgattccctgggaaaagcccatggcgacctgcaggggaaccatattgattttctgggtgatgcccatggccgccactgcctgggcgccgtaggaggatgtaaaattgttcagtatggtcatgcctgtcacattcagaagattctggattgccgccggtatgcccacgccgcacactcccagcacaatgtacttctgaaaagaaaacttttttggattgatacagacaaaagttgttttcctcctgacccgcagcagcacaaaaaagtagacacaggcaacacagttggaaagaaacgtggcaagtccggcccctgcagctcccatatcaaatccccacggcagaataaagatggggtccagaataatattcagcagacagccgctcatggttccgatgctggcatgaagagatgagccctcagatcggaccatgtatgccattaccacattcaggatagccggagcagcccccaagagcactgtccatctcagatatccggccgttgcatccattgtattggcatccgctcccagaagaatcagaaggggattcaggccaaccgtgcacaaaacagaaaaaagaaggccgaaaaacagggcgcagtaaaacccgaacgcgctgctgcgccggaccgactcataatcccgacgccccaatgcccggctcatcatgctggagcttcccacgccgaacagattgttgaccgcattgaaggccaggagtacaggcgccgccagcgtcaccgcggcattctgcacagggttgttcatcattcccacaaagtatgtatccgccaggttgtaaattaccatgaccagcgaactaaggatagttggtactgccagctgcatcacagcctttggcaccggtgtctgctcaaataaaatagtcttgtcatccatcatatgtaaattgcctccttgccccgcgcaggcagactgtgcaggcttcttttgattctaccacgggaaggattacaaaacaagctcttcatctcccttcaaaccggtcctggcaatgcggcaagaccgccgccttcgccctccggggaaattttcaacgcaaaattccaacgcaaaaggcgggtccggcctctgccggtacccgccctcctgttttatcggttaagggggcgccaattccgccttccgtcttcaaatcccactctgtatccgtcgttaaagcctgcgcggtaagcctggcgcctctcgcctgcacacgggtcccataccggccaccagttattatcccagtcattctggttggagccccagcacctgcagcatctgcagcaccggcagcatctgcagttgccaccgcagccattaccgcagttaccaccgcagttattaccgcaattaccgccacaattacaacatctacaacacctacagcagcatctattacaacacatatcaaaacctcctctaataaatatgattatggtatattgtatgggacaggtggacaatgtgttactcttttccggggcttttcctttttgtgtacttgctatgtaaatatttacaaacccctttcaatggactatacttattttggaacatcgtgggtaacatcttatgaaacgggggaaggggtcgtgtctgaaatcaaggataagtattccgtgggggaagctgccagactgagcaatgtgagcacaaaaacactgcggtattacgatgaaattcagcttatcatacctgatattgatgagaacaataattaccgttattatacaaaagaccagattcaggatattatcaccacaaaaaaattaaagaatgcaggcctgaaattaaatgaaatccgggattacctgcaaaagaaccagagacaggataaggtcaaattgctcaaccgcaagattgaggactgctccagggagcttacacgcctgcgcaaaagcatactgcgcctcagcgatttccgcgaccgcctgtcagaccagttctatgataatctgtcctcttctgccggacaggtgaaacgtgaaatctattctcccggactcattgccttttccaatcattacagcagcgcctatgtcagcaacctctttctggagtatgaaatagagctggaaaattatatggacacgcgccacctggagattgccggtaaactgaccgcattcttttatgaccatttcagccaccagttttttgatattcccacccactttcagattttttatcctattaaagaaacctcggtcagagacagccagatcaaagtcatgccggaatatccgtgcctcaccaccatacaccttggcagctataaggaaatcatggaggcctaccaccggactctggcctatgcaaagaaaaacggaatcatattgacaggccagtcttttgaaagctatttcatcggacccaatctgattaaaaacgcagatgagtttgtcacgaaaattcacatggtcatctgtcaaaatccatagcgctttgtttctctgcaaccttccccttaagaggaaggtttttctttttcaattcggttttatttcaaaatatttcttgacaatcccttatagagcatgccttataatgacattagttaatttttaaacatattatcagattattattccataaagaaaggagcttacttaaatcatcagcagcggattaagtacataaataatatgaaaaaaataggatttatcgtaaatcctgtggctggtatcggaggaaaagtaggattaaagggttcggacggaacccagaccctgaaaaaagccctggagcttggcgctgttcctgaagcaggcgcaaaggccctgggcaccatgaagcttttaaagccaatggaacaacagctggaaatccatacctgcccaggcaatatgggtgaagacatctgcaaacaggccgggttaaactaccgcttagctgaggggaccaaagcctggagccagtgctccccctcttcccggaacactactccgaaagacaccatggacgctgccgggatgctctgcaatgaaggagtggatttgattctgtttgccggcggcgacggaaccgcgcgcaacatcctggatgcagtgggaacctccattccggtcctgggcatcccggcgggatgtaagatacattccgcagtctatgcccgcactcccagggcagccggcgaactgatggtccggtatgcagagggcagggtcatggaatacagggaagccgaggtcatggatattgacgaaaatctgttccgccagggcatctgcgacgccaggctgtacggatacctgaaggtccccaacgaaaagaaatttgtccagaacttaaaaagcggcaggggctgctcagaggacgcgtccatccagtccatgtgcatgtacgtcagccggctcatagaacaggagccggaatatctctacattgtgggaaccggatccaccacagcccggctgatgaattatatggggaagcccaacaccctgttaggggtggatctccttttccggggccaggtcataggctcagactgcacggagcaggatatcctggcagcgcttaaaaagtatcccagggcaaaaatcatagtcactgtgattggaggacagggatatatattcggcaggggaaaccagcagatctccgccgaagtcatacgcagggtggggacgaaaaacatcatggtcattgcctccagggacaaaatcttttctctgggcggaaaccctcttctgattgacacgggcgacgaggaggtaaaccgcatgctcaccggatatattccggtcaccaccgggtacaaggacgtaatcatggcaaacgtaatttattaaatccacaaataaaatcaaaaatcaggaggtaagaaatggacagcaaaaaaacagtatacccctacatccctaactctgcgccggatgtacaggctgagatgatggctgaggtgggaatcagtgatgtaatggagctctatgaagaaataccggaggccatccgttaccagggagccttaaatctgccggaggccattccggatgaacagggaatcaaacgccatatcgaacgcatcctgtcaaaaaacaagaactgcaatgaattctccaacttcatgggagccggctgcgcccagcactatgtcccggcggtctgcgatgaaattgcatccaggggagagcttctgaccacttacggagccgagacatgggccgaccatggaaaataccagatattctttgaataccagagcctgatggcagagctgttagacatgtccttcctgaccgtcccatgccactgcggcggtcaggcatcagccacaggccttcgcatggcctgccgtatcaccggaaggaacaaggttctccttccccataccatgaaccgtcagaacctggctctggtgcgcaattacatgaaaatgatagatccggaccaggaaattaaaattgaactggtagcctgccgaagcgataccggaatgctggacctggaagaccttaaatccaggctggaccaggatacggcagctgtctacattgaaaatccaacctttctgggtatcatcgaaacccagggtgaggaaatcgggaagctggctaaggctgcgggagccgaattcatcgtgtatacggaccccatttcactgggcgtactggaggctcctgccaactacggcgctaccatctgtgtaggcgaccttcacggactgggccttcatctgaacttcggcggcggccaggcaggctttattgccagccatgacgatatgcgctatatcacggaattcaaggagctggtagacggaatggtggaaaccacggtacccggggaacagggctattcggttgtgctcatcgagcgcacccactatgccatgagggaaaacggaaaagagtttaccggaacccagaacaatctgtggaccgcgcctgtggctgtttacctgtccctcatgggcccgaaaggcatggaggaaatcggccataccatcatgaccaacgccaaatacgcggctaaaaaactggctgggattcccggcgtctcactccggtttccatctgtgttcttcaaggagtttgtggtgaatttcgataaaaccggcaaaacagtggaggaaatcaatcagcagctgctctcccgccagatttttggcggcgtggacctgtcccgggattatcctgaacttggtcagagcgctctgtactgtgtgaccgagactgcagacaaagaatccatagaccggctggctggtgcgttacaggctatattaaattaagggaggacattagaatatgaaacgagattacagcaaacatttacgcaggttccatgaagcaaaatgggacgaagagctgatttttgatttgtccgttcccggacagagaggtgtcaatgtaacaaagccaagtccccggataacagaagaagtgggcgacggcgccgacgacattcctccctgcatgagaagaaagacacccccgttcctgcctgaggtacaccaggccagggtcaaccgccactatctgcgtctgacccaggaaatcctgggcaacgacattaccccggatctgggcgaaggcacctgtaccatcaaatacagccccaaggtgcaggagcatattgccaatacccatcccaacatcatcgacgtacacccgctgcaggatgcatccaccatccagggcatcctggaaatatacaaaaaaacagaagaaatgatttgtgaaatttccggtatggacgctgcctgctgccatatgggcggaggcgccgctgcctgctttgccggagccagcgtgattcgtgcctaccatgaggcaaagggcaatacccagaaggatgaaatcatcaccaccatattttcacatccctgtgacgcaggcgcccctgccaccgcaggttacaaggtgatcaccctgatgagcgacccggagacaggcatgccctccctggaagccttccggagcgccttgtcagagcgcactgccgctatctttatcaccaatccggaggatacaggcatcttcaatccccagattaaggaaatcgtggatgctgcccacgaagtgggcgccctctgctactatgaccaggccaatgttaacggcatcatgaccgttacccgggcaaaggaaatcggagctgatttaatccactacaatctgcacaaaaccttttcctcccctcacggcggcatgggacccggcgttggcgctctctgtgtcagggaaccgttaaaggtctttctgcccgtaccccgggtggaatacgacggcaaacagtattatatggactgcaattgtcctgaaagcattggaaaggtccgcatgttcatgggaaatgccaacgtaatcctccgcgtttacatgtggatccgccagttaggagccgacggcctgcgggaagccgctgtgtgcgctgttctcaacaatcagtatatgatgaaaaaggtgggacagattaaaggcgttaagatattctatgccgaggggaaacgccggattgaacaatgccgttacagctggcagcccttaaaagaggacaccggctttggaaccgtggatgtgaccaagcgtctggtggatttcggcatgcagcattactggcagtcccaccatccgtggattgtgcctgagccatttacgctggagcctacggagtcattttccaaggatgatttggatgaattcgcggccatcctcaaagagatatccagggaatgctatgaggagccggagacaataaggagcgctccccataacgctcccattcataacaccctgttggatgaagtcatggattttgataaaatagcagttacatacaggcagcttcgcaaacgcatggaagccggcacaatcagcaaggatattctcggccagtagcaggtaaaagcaaataagaggaggaaacaagaatggatcacaaagataactatgaccgactattgcccatgccggtaaaactgggttttggtattgccaacttaggcgacacagtcatcactgagtttgtaggagcatttttcatcttctttctgacaaatatcgcaggcgtgcggcctgccctggccggtaccattgtctttctgggagttatgtgggatgccatcagcgaccccatcataggaaccatgtcagaccggtgcacactggaagccgggcgcagacgtccgttcctgctgatatccaccgtgcccctgatcctgctgactaccatgatgttcacaaaagtgaacttttcagctaatttaaagtttgtatattttgttgttgtgtctgtgttttattggaccgcttacaccctgttcaatattccctacctgtcactgggttctgagctgaccaccaacaacgatgaaaagacccgcgcttcctccatacgccaggtattcggcacctgcggcctgttttttgccaacgccctgcccatgatactggtgagcctgtttaagggccagggaatcagcgaggaacgtgcctggacattagcagccctcacactgggcgccatagcaggtactgccatctttatcacatggcgcgccaccaggggatgggaaatcaaatacccgccccagagcaaggatgagcccattttcaaaagtctgggcaaggtgctgacgtataagccttacattctggtgattgtggcctccttcctcttctattttgcattcaacacctgcaatgccagcgttatttacaataccatcgtggtggtgggcgcaactgaggcagatacggctgttgtgtatctggcaggcaccattgtgggcgttatcctgtccgtgcttatcggaaagctggctgttgtgtttgataaaaaatgggtctttatcaccttcatggccattgcaggctttgccctggtaatattcaaatttgtgggcttccacagcatcacggaccaggttatccagttctgtatggcgcactttgccattataggcttcctggtgctcagctataacctgctctatgacgtatgtgaggtttatgagtttaagacaggggagatgctcaccggggtcatgatttcctacttctcatttttcatcaagctgggcaaggcaactgcgctccaggcagttggaatccttctggacctgggcggctacgacgcgtcgctcaccatacagccggacagcgccaaagccgctgtcaccaatatggcttccatcattcccggatgcctgatgcttctgtgcgcgctggttgtctgcttctatcccataaacagagtccgcttccgcgccatgcagaacgccagaaaacttaaggatgagggaaaagcttactcaacaagtgaattcgaccgtattctgtagtgtctgacaggttttgcaaagataaatctctaaccataagaaattctacccataagaaatggcagaaaaagggacggtaagtatccgtccctttttagtatgttctattcccggccctgctttacctccccggccgcctttacctccccgactgccttcaatgccgcaggcttcaccgcatccctcttcgccgcatccctcttaaccgcagctcttttcaccgcctcagccactgccttagccacacgttcatcaaacgcagaaggaatgatatactcctcccccagttcttcaccgctgaccaggcccgcaatcccgtaagctgccgccagcttcatgtcgcaggtgatgtccctggcccggcagtccagggctccgcggaataatccgggaaatacaagcacattgttaatctggttagggcagtcgctcctcccggtagccatgacgcgggctccggcttcctttgcttcctcatacataatttcaggcaccggatttgccatggcaaacactatggcatcttttttcatggttcttaccatgtcctttgataccacgcctgctgccgagacaccgataaaaacatccgcgccggcaatgacgtcctcaagccgccccttttccttccttatgttggtcatcagggaaagcttttctttatgcccatccatcttttcgcggccgggacacagcgccccgtgctcgtcgcagacaatcaggtccttgacccctgcgccaagcagcatctcagtgatagccgtgccggcgcttcccggcccgtttacaatgaccttaatcccatccatctgctttcctgtcagcttgagggcattgatcagggcggccgtggccacaatggcggtgccgtgctggtcatcatggaaaacaggaatatccagctcacgctccagccgctgctcaatttcaaaacagcgaggcgcgcttatatcctccagattgatgcctccgaatgtaggggcgatccgctttacagtctctattatttcctctgtgtccctggtatccagacagatggggaccgcgtccacgccgccgaattttttaaagaggacggcttttccctccatgaccggcatggcggcctccgggccgatatctcccagtcccagcacagcggttccgtccgtcaccacggccaccaggttgccttttgccgtataggtgtatgcctcgctcttgtcctctttaattttcagacagggggcagccacccccggtgtatatgctgtgctcagctcatctcttgtggttaaaggaatcttgcttgccatttccagtttgccgtgattttcccggtgcatttttaaagccgcctctgcataatccatatcccgtgcctccccgcgtcattttgttccgtactatttttcatctatattattcttcatcagcagctctttacccgatatcccgggctcagtcatccgcaccggatccaggatatggtccagttcctcctcatccagcagtccctcctggagaattatgcttctcacggacgtgccggtctgaagggccttcttggaaatatccgccgccttctcatatcccacgtggggagaaagggccgtaatgactccaatgctgttttccaccagggagcggcatctctcctcattggccgtgatgccggatacgcagttgtccacaaatgtcctgaccgcataggccagagtgtcgatggactggaacatacagtagaaaataatgggctcaaaggcattcagctccagctgtccggcttccgccgccatggtgatggtcaggtcatttccaatgatgttaaaggcaacctggtttaccacctccggtatgacgggattgaccttgcccggcatgatggaggatccgttctgcctgaccggaagattgatttcattaaaacctgcttttggtcctgaggacatcagtctgaggtcgttggcaatcttggacagcgtcaccgcgcaggccttgattgcgcccgatacagctacaaagggatccagattctgggtggcgtcaatcaggtcaaaggcctgcacaaactccatgttggacacctccgcaagattgggaacgattcttctcagataagcttcatccgcattgattcctgtcccaatggcagtgccgcccatgtttaaggtgcacatctcctccatggccttgtccatacggcggatatcccgcatgacagctacagagtacgccttgaattcctgccccagacggatgggcacagcgtcctgcatctgggtgcgccccatcttgatcacatggtcaaattcctccgccttatggctaaactccctgtgaaggcgcagaagctctgatttcaggttttttaacagccgcagggaagtcatcttaccggctgtgggaatcacatcattggtggactgtccgcagttcacatggtcgttggggctgactataaagtagtctcccttctggccgcccagaatctcgatggcgcggttggcaatcacctcgttggcattcatgttcagggatgtgccagccccgccctgaatggggtcaacaataaagtcctcatggaacctgccttccagaatctcgtcgcatgcctgtacaattgcctccgctgtctttttttccagcagcccgatttcgcagttggtgattgccgccgccttttttatgtatgcaagactgttgatgatttccgggtgcatattcagaccagtaatctggaaattctctgccgcgcgcatggattgtaccccatagtatacattttccggcacatcctttgcgcccactgaatccatttccaccctgtaatcttttcttccgtccattttaacgaaacctcccatatacgaatgatataatatcaagttgatgttattataaggctggggtataatataatccaatacatatggttctatattgattataactttgaaagtatactttttggaaaataaagggggatgttatgtttcagggaatggaatacatctacacggtctatcaggaaaaaagcttttccaaagcagccaggaagctgttcatatcacagccctccttaagcgccaccgtaaaaagaattgaggaacacataggctatcctatttttgacagaagtacaaagcccctgaccctcactgagttcggcaaacggtatatcagctctgtggaacaaatcatctccgtagaacatgaattcagcagcttcatgaacgactggggcggattaaaaacaggaaaactggttctgggcggcagcagtcttttttcatcatgggtgcttcctcctctgattggcagctttacacggcagtttcccatggtaaaggtggaattgatggaagaaaatacatcggaactcaaattactgctgcaaaacggcggaatcgaccttatgattgacaactgccagttggacaagactgcctttgacagccgtgtctaccgaacggaatacctgcttctagcagtgccggcagcccttgacgtaaacagggaagccgcccggtaccagattcctcttgaaatgattcatgacggttccttcctggacagcagcattgcgcctgttcccctggagcggttcagcggggagccttatatcatgcttaagccggataatgataccagaaaacgggcggtgaaaatcctggccggccataacattacccctgacatccggtttgagctggaccagcagctaacatcctacaacatcacctgttccggaatgggcatatccttcatcagcgatactctgattaagcaggtccccttccaccccggcgtggtgtactataagctggacggcagcctctgccagaggaatctgtatttttactggaaaaacggacggtatttcagccgggccatggaggaattcctcaatatagcaaaaggggatgcaaaaccagcgtaagccggtactgcatccctctttatttcatattattatcttccgctcccatgccccgcagagccgaacagcctcatcttttccatcacggaccgtttcaccgcctctatctcaggcagtatcatatccgtaagtcctattccttccctgtatccgctgcctgcggccctggccccggcctggttgatatctgtaaaaatattgaccttgctgattccccgttcaaccgctgtcctgaaatcagagtcagacagaccggatccgccgtgaaggaccagaggtgtggaaatggtttctgcaatttccgaaatccggtcaaaatccagcttaggcggaagcttataggctccatgggccgtgcccacggcaatggccagagcatctgccccggtccggtcaatgaagtcccgcgcctggaccggatccgtgtaaaactgcgacggttcagacccagggctgcttccttcagcgcttcctccttcattatcccccacatggcccagctccgcctcgatggaagcaccgaaggaatgggctgtttccgccattctttttacatgctccatattgtccccgtagtccatagtggaacagtcgtacataatggagctgaatcccagttccagagccagcctgcacgtctcctccttcaggccgtgatccaaatgcaccaccaccggaaccgacgccctctctgccatgggaatcagcaggtttgccaggtcccttaagggaccatagggcagcagtacctctgctgtaccgatgataacaggggaatccagttcctcggcagcctccatcacgcctctggccagctccaggttgaccgtgttaaacagtcccaccgcatacttacccttcctggcgggaaccaatacatcatttaagtttaccagcattgtcctttacctgtccttcttactttgtctttaatgcgtcgtcaaaggcaatatccgacggggaaaaattaatcttctttgtaaacgcgcacgcctctgtacccccgaaaatacggtccatgccgctgtcctcccattcgatggaaagaggcccttcatagcccttcacgttcagtacccggatgattttatcaaaatccacatccccgtggcccggcgatacaaagttccatccccgtctcgggtctccgaaggtgatatgggagcccaggattccatttcttccgttcaggttcactgccgcatccttgatatgtacatgatataccctggaggcaaaatcatagaggaacatggccggatccattccctgccaaatcagatggctggggtcaaaattaatacccagtgtctcacggtattcaaacacttccagcagtttctgcgtgctgtaatagtcaaaggcgatttccgtcggatggacctccagggcaaacttcacaccgcactggtcaaacacatcgaagataggggtccacagctccttaatctgtttaaatcccgcctctaccatttcctctgtggtctgggggaatgaataccacatcttccagataggagaacccatgaagccggtcaccaccttgactcccatggccttcgcggccatggcagcgtattttaactgctgtatgccccatgccctgatttcctccggcttgcccgctagttctgggggcgcgaacccgtccagacgcgggtcccacacatcgcccacacactggcccggcaggtgggcgccgatagcccagcacccaagtccgtatttttccagagtgcccttcaggttctttacatactccggatcctctgctgccttctgtaaatcaatctggccccaggaggcaatctccagtccgtcgtatcccatgtccttggctgtcctgcacatctcctccaaacccaaatcagcccactgtcctgtaaaaatcgttaccggtcttgccataatcatttcctcctaaactccacccacgtattcccgttctgattgctttccagacaggcttccacaaacgccagcccctcagcgccctgactcaccgtgggataatccaccatttccgctgtaaacgttccatccttttttgcgcttacgcattgtgcaaagctgcggtagagattgcccatggcctcaaaccagccttcgggatgtccggccggaatccttgcgtatttacctgccctttccccgatggcgccgtatccgcggtgtatttcccggatggtattgtctgcgtcaataaccgtaatcttatcaggcgtttcctggaaccattggatggtgcccttactgccgtagatacggattctcaggctattgtcatggcccaccgccacctgcgacgtccagtatattccggtggcgccgttgtcatattccaccagaatgctgtcgttgtcatccagtacccgcccggggacaatgacatccatcttagccagaaggcgcttaatcttaagcccggtcatggcagccaccgcattctccacatgggtgcctaagtctcccagacagttcactccgcctgactgaccgggatcgcagcgccactctccctgctttcccccgaaatcgtcctcaaaggcaagccagccctggggatattccgccatgaccgtgcgtacctctccgatggcgccggaggccaccagctccctggcatattttgcagtcacataacccatgtaggtataggttaccataaacagaagtcccctatcctctgccagggcttccagctcctttgcctgccggtacgttgttgtcaccggcttatcgcataccacatggattcccgcctccaaaaaggcccggcagatttcataatgggactggttgggggtgaccactgtcacaaagtcaacgccgtcctcacgttccccctcagccctggccattgtctggtaatcctcataacaccggtccggggaaatgccaaggctttccgccatctgcaatgatttctcacggtttcttgaaaatacccctgccgcgatggctgctgttccatccagcccgattgcccggcggtgggcatcgccgataaacccatccggacccccgcctaccattgcgtatgtcagtctctttgccatcttttttctcctttcatgattggttctgctgcttttttacgctccgccctgtcacggtctgtattcccgtttgctccatccctccctgattctctctttcatttcctccagggaccgtaatccgctgagggcgtcataagcagccacacagcatgccccttctgctgctgccatttccactgcctcctttaaatcagcttctctgagaacagaggccaggaaggcggctatgctggtatcccccgcgcctgtggcggataccactgtatccggttcaaagctcggctcaaagccctctttgcccttccaggcttccatggaaagattcagctgcctgcacatgtcctctatgccgtttttgcatgccgtgcggtaatagatgcctaaagcgccgcatttaatcaggacaaccctggcccccatgtccagggccatctgacccagaggctttacatcccggacccggattacctctgtgacgtcctttccgtccgcccgtttggtccactcccggtaacgctccccatccagcatgaagcacagctcctcggcgcttggcacaaagaaatccacatagggcaatatgtttctcaaaatccctttccagtccgctccggctgcttttgaggccgggtcaatggcggccatgtctaaggatatggcggttcccccttcttttatctgcctgaacatccgggccatctcttctccctggttccggtacatgttttgcatcagggtgggatatccgaaatggaacaggtccgcctctttgatcgcctcaaaatccagatcgctgcctgaaaaattcacattggcgcccggatcatgaaggaaaatacggtcaattcccggaatagccaggacaacggaataagaagtcttttcctggtccgccaaaatcattccctcagccgccccgtatttctccagacagttaaggataagggttcccagttcatcttttcctatcttacccatcagacggacatccactcccagatgcttcatggccaggcctgtattggccactgccccgccgggatggatattcaccccctccatctgtaccagctgtccgggcgccagtatccttcctgcctctcctgtactccctttcgggaacaggggagtgatgtcaatgcatatatgtcctgccgccaccgcccttttgccttttgcttctctcttgttttccgctgctatctcatcagccaccacaacaccccctttcacgggtttttccctttggcctttccagctggtcttcccgtccggccttcctgttttacctacctatccgctgtttccatccttcacattcacatcagacaaggcccatcaggagattcatcacatacatttccagcccctcaaagtctctgttcctcacacattccttctggaactcatagtcaaaccggtccgccttttcttccagtgccttaaatatgttcaggctgttctccagatgcttatagctgtcctgatccctggtggtcctcatggcctttacatccaggcccacatactccccgttttcaccgtagccattctccttcagcacctttacctggttaaaggcagccctcaggttttccacaccaaaggctttatcctggtcatacttgataccgttctggtcgttgagatggacggtcatcagtttacccattgccattgcaaacccgatttcatgggcagggtcaaggccggccaggatggcatgggcgctctccaggttgccgcccacccgtcccgggtcaatggtggctgccgacacagccagcacatggcccatggtcccgcagatgcttctgtcaataggctcgtttggcttgggctcaatgcaaatccggatatcagaatcatattccagcattttattgatggcctgaatcagcatcttcgtggcccatacaggggatttggactccgcacagagggttccctcccttgccagccacagcaccaccatattacagcccagctcctttgcaatgtcaatggagcggtaagccctccacatggcgtattccctgtcctcctctgaggtgctcataaatccgccgtccgcggtccgcccgtccatccagagcctgggagccacaaactcagcagccagtccgtatttgtccagcatctttttaagggttctggccttttcctttatctcttcctccgtataatcattgatattgggcaccgcatcgtcatcgtggaactggatggcggaaaaccccagctcagcgaatgttctgattttctcctcaaaggcaatttcatctctggtcgcgggtccgtaggagtccgctcctgaatgcacattccacggtcccacggaaaacttgaattttgtcatatccttaccctcctgattcatcggttatctgtatctcatacctatactatatcaagttcccggcctcaaatcccaaacaaatttacggttcaaaccatgacaaatttgctttttactttacaagcccgcccccggggacgtatactgtcagaaagggaggagataccatgaaccaggagtttgaaatcatatcccacagccagatgaactttaagctttttcttgtaaatatgctttaccgcaccccccatatccataaggattttgagctctgccttcttctggacggcagtctctttcttcaggcccaaaatgaaacccacagcctgaagaccggggatttctttgttgtgaatccatttcaaagccatgagctaaaggctgattcccctgccctcttagtttcattacaggtacacccatcctttttttcttcttactacccgcggattgccaatctggaattcacctccctgattcttcaaagggacgggacggatgtccgcaaaaaactgtatgacatgatgatagagcttgcctgtctttacctgaaaaaagctgacaaatttgaattaaaatgcgtaggccttttaaatctgctctttgccggcctgctggacaccctgcccaacaggcttctgtccgacaaggaaaaaaacgcctcccagagcaaggcttcacgcatgcgcaaaatcacccactatatcgacgaacattattcagaaaaacttctcctgtcggacattgcccgcaaagaagatttgagccttacctacctgtcccacttttttaaggattacctgggacttccctttcaggaatacctggccaaaatccgatgcgaaaaagcccgccagcttttattgctgacggacttcccattgttagacatctgcatgtcctgcggtttttctgattccaaatattttaacagcggcttcaggcggcagtatggatgctcccccaaggaataccgccggaatttccggcacgatgaactgaagcagcagcaaaaatccatgctcaccacccaggagttcctgtctgcgtcctccagcatcgtgcttttagaacgctgccttcttccccagccagcaggccccgcagcgtgttcatgacaaaatcacggtatgacatgctctgcggacaattccttgatgacaagacggtatgttcctgacggaagttccccgtacattgtcagatgattgatcatgctctgtttgcctccgtccggtatataaaaccccatgcagttaaatccccagttgcccggcatggccggaatctcataccacacgccgtcaatcagaacctgcagctcataaaattcaccgcagctccattccccgccgctctcattgttaatggtcacggccgctatatccttatcccaggaatccagcgtcatggtaattccactgggaggatttaaaggagctgccggaaccaggaaccgggtattccacttatctttttcctgtgtgaatacacgcgcgcacggaaagtttgtaaaagagggcagctctcctgcactctcccactccttcctctgcttcagagcttcaaaatcataatcgaattgatacacagacccatcctgggcaatccacctgccgttggtccacgccgcaaacaggctcagtccatcctcccggccaatctcaatcccgtaaacaggcagggaggcatccttggccgaccagtcctccgccggctctgcctttacggaacttaagtcatccagtatctccctctccttttcgctgtcaaacatatagtaaaggcgcacagatgttccgtcgtatatgaacagagtcatggcgctggtttcaggcgatgccttagccaggagaccggaagaatccggcttcgcaggctctgcttcaccctttagaacaggcacttcctgcacgttgagagcagcctgttctgattcggcctgtgtctccggcggactctgtttttttattctttctttttcattcttttccgtatctgccgtacctgcctcagctttttcagtactgtctgccggtgccttcctgtctcccgatgagactccggccttttctgccggcgctggggcatctcccatcatcttaccgcaggcccccgcagccaccataactgaaatcaaaacagccgcaatggtcatcacttttctgcgttccattaatatctccttctgccgtcacactcagaaccgtcaatcgttttgaatattataacagacaaccccataaaaacaaagtatatatcaccagattacagcggtttttcctcggttccagtctgcacgctctgatatctttccacaggtcctattctttttccctgacccatgttataatttaagcacctgaattcaccccaatacagaacggagaatatattatgaacgagcccctgcactttaagacacgtaacgagttccgcatttggctgatgaatcactgcatgtccggcgacggcgtatggctgaagtttgaaaaatcaaagaatacagcgtttaaggccggcgacgccctggaagaggcactgtgctttggatggattgacggagtgatgaaacggattgacgatgaatcctatatcaaatatttttctgcccgcagaaaggacagcaaatggtctgaaaaaaataaagcgctggcagaagacctggaaaaacgcggcctgatgactgattttggcagagagaaaatacaggaggccaggaagaacggtcaatgggacaagccttccggaccgcctgctgtcacagcagaacaaatcgggaccgtggccggccttttaaaagaacatgagccggcctatactaattttcagaaaatgcctccatccgtccaaaaaacctataccagggcatactatgatgccaggacagacgccggacgcgccagacgctttgcatggatggttgaacggctggagaaaaatctgaaacctatgtgacggcttatacggcagtcattttactttttcagccctgcttttctaaacacctttttgcccttttgaatgatgattccgtccatcagcatgttccgggtcacggtaaagtctatggattccacccttttctggctgacctggatgccgccctgtgtgatcagccttctggcctcgctttttgaggccgccagtctgcacagcaccaggagatccatgatattgatgctgccctggacaagtttttcctccccaacctctgtaaacggcatgttgtcatcatccatggccccggtaaacagggaaacagaggtctcctttgccctgcgtgcctcttcttccccgtggaccagagcagtcaggtcataggccaggatttcctttgccctgtttaactgtgctccctcccatccgtccatggcatcaatctcttccaccggaataaaggtcagcatacggatgcatttcatcacatccgcgtccgcgatattcctccagtactggtaaaattcaaagggagatgttttctccggatccagccatacagcgcctcttgcagtcttacccatcttgtttccttctgagttcatgagaagggtaatggtcatggcatacgcgtcctttcccagcttcctccgaatcagttccgttcctcccagcatattggaccactggtcgtcccctccaaactgcatgttgcagccaagctccttgtacagatggtaaaaatcataggactgcataatcatgtaattgaattccaggaatgacaatcctttttccattctctgcttatagcattccgcccgaagcatattgtttacggaaaaacaggctcccacgtcccgaagcagttcaatgtaattcagattcagcagccagtccgcattatttacaacaatggctccattctccccgtcaaaatcaatgaaccgttccatctgcctcttgaagcattcacagttgcggcgaatcacatccggccccatcatggagcgcatgtccgtgcggcccgacggatcgccgatgtatccggtgcccccgcccaacaggaccacggggcggtttcccgccatctgcagtcttttcatcagacacagggccataaaatgccccacatgcagggaatccgccgtggggtcaaagccaatatagaacttagcctttcccgcatttacaagctctcttatctctgcctcatccgtcacctgcgcaatcagtccccgcgcttccaattcttcataaattcccatgtcttcctccttttagacaaaaaaataagcccctgcagcagcttgctgcagagggcaggttatgcggtaccacctctgtacttgaatatccttcacagaatattcctcatcgagtgtctgtcaacactctcacgctgtatcgggcgttcccgtcaaaccctactaaaaccttcaggctgctgctccggagcgtattcatacagtctttcctgcgtccttccaccaaccggacgctctctgtaagaaaagcctctgtactactggtctccttcatggcattctttattacatgtgcagtatagcaggggacgcgtcaaaagggaagtcacagatttacacatgtgtgacaggagacatctgatattttttaatctcttccggcagggtttcacaaatcagccgcgccatcttctcagccggaagatctatattgccaagcatccactgaatcaccatgtcgcttccgccgcgcacagctatttcaatggaaaaccacataatctcagaccggatgtcagctcccctttgcttcaggaatgtctcataaattcttctggtaatctcgatatcatgattcttcaagccattgatatcacggctctcatatgcatgtttcagaacactgcgcttttgccggtaaatcttcaggcactgggtcagcgcttcctccagaccggcgcccaacacaatgctgccaaagctctcttcgtaaaattcatcgtaataccagtttaccagttcgtacttatcacagaaatggcggtaaaaggtccttcttgatacacctgccatctttgcaatttcacttaccggtatatcatccagtttttttctgctcagcagatattccatggcttccgacaattttttcctgatgtctgttatctcatccaatgcaaaccttacctctcttgtactgattttgtgcctcttatcctgattcatgctgatattatatcctttcccggcgtccatggcaacatccataacaaaccggggatatattcattttcatgttgacacagcaattgtgttatgagatacttttatatatagtattgaatactacatatggaggtgttatatgagaacagcgattttaattgattccggctgcgacgtatcccaggcattagtccagcgatatcacatgaaggtgatgcaccttcatatcatttatccggaacgggattatattgacggggtagatatcctgcctgagaccatttaccagcgttttccgggagaaattcccgccacctcaacacccagtccccaggatgtgaaggatatggttgaagaaatcaaggcagagggctatacccatgtgctggcattctgtatttccagcggattaagcggtacatataatacggtgggcagcgttttgggggatgaaaaagaccttacttcctttgtgctggacaccaggagtatctcctttggagccggtatcctggccgtgtgggctgccatgcagctggaagaaggcagaggctttgatgaactaaaagaaatgcttcccaaaaaggtaaaggattccaaggtattttattatatggatacactgacctatctgcgaaagggaggccgaatcggtctggtcacttccgtggtgggaagcatcctgaacataaaacccattatctcctgcaatgaggacggggtctactataccgccgccaagatacgcggagccaaacaggccctctcccggctgttgtcagaagccagctcctttgcaggcggacgcccctgcctgactgctctgttaaacggacaggggcagggtgcagctgatgaattgaagccccggctgattgcaggcatcccggagggacgcctgattatggaaaaagccatcactgcgtccctggccgtacacacgggtcccggactggtgggaatcggggttcttcgcctgtagaaggtacaaaccggttctctcagctgaacttatccgccagcatctggtaaagcaggtccgggtctatgggctttgccagatgtccgtccatccctgcttcggcagcccttaccacgtcctcatggaaggcgtcggctgtcatagctatgatggggatggaggccgcccttttatggccggactggcggatagcctgggtggcctggtacccgtccattaccggcatctggacatccatcagaatcaaatcataggtatccccttttatcagaaattgctccactgcctctctcccgtctctggcatagtccgccgtgacctctgccatgttcagaaactccactgcgatttcccggttaatgtcattgtcctccaccaaaagcacatggtgtccggccagttcaggccggtgaaagctttcacgggagccaggcctgcggaccgccttttcgattccggttgcggacagcagcgcattataaagagtagaggcaaaaataggtttagccagaaatgcattggcgcctgccgcccgcgcattcttttcaattgccccccagtcataggcggttacgatgatgataagcgtatccggacccactatctccctcatgcgccgggttgtttcgatgccgtccatatccggcattctccaatccaccaggcagacatcataatcctccccggcctgatgcatgacgcgcaccttctccacacactcccagccagtctgaacccagtctgactggattcccagattctgcaaaagaagggatgcgtggatgcagctgtccctgtcatcatctgccaccagtaccttgagcgcctgtatggcatggggcttctgttcctgggcatccacatcttcattctgcaaatcaaaatccagttcaatggtaaatgtgcttccctgtcccaatttactcttgacagaaatagtcccgcccatcaatgtaaccagattcttggttataggcattcccagtcctgtaccgccatatgactgcccgccggacacacgctcctgctcaaaaggctcaaacagatggctcagaaacgcctcactcatacccattcctgtatcgctgaccgtaaagctcagacgcgttcttccagccttcttccacatctgccgtatttccagccggattgttcctccctcaggcgtaaatttaagggcgttggataacagattgattaacacctggttcagtctcagtccatcgccaatgagaaccgtattggtaaggtttatcaaaggcaccttaaaggacagccctttatccgctgcctgcggatatacaatagatgtaatggactccaccgtggtctccagattaaatgcctcatgggcaatcttcatctttcccgcatctattttagacatatccagcacatcattgataagcgtcatcaagtgcttggaggaataaccaatcttttccaggcagtcctccacccgcttgcggtcctcaatgtaggcggctgcaatggtggtcattcctatgatggcgttcatgggcgtgcggatttcgtgggacatgcgcgagaggaaatcggattttgcccggttggcatgctctgccacagacagggcgtcctttaacgcctctgtctgggccgtcagcttccgctgcatttcccttagttccgttacatccgtcacatcaataaaaatcaccagatataccggttttccctcctgccagtcaacacaggtggcattgacctggagccataaggtctgcccgtttcgtccgttgacatgcatggtaaaatgcagcggctccccggccagtattctggccttctgtccttcaatgatttccagattgttctggatattatttttataaagagagctttccccacggccgctgccctggccaaaacaatccagaaaacggtcgttagccgacagcagggtcagctccatctcattattgatatattcaatccgatactttgccacaaaccccggcagactttcatatgtaaccgactgctctttgcgcatcttcataaggtcgtccacattggtaagggtggagtaggctacctggtacccgtctatatattcctccgcaaactgggtggaaaactgaacccagacataatccccgtttttcctgcggattcgcgacagaagcctgtatccgtcctgcccttctcctaacgcctttaatacagtctctgagagcttcttccactcatccgggtctgactggtaatacaggtccggccggttgtgataggtttcctcgtactcgtcctttggccacccaatcagctgataataaaattcattggcccaaatcaaggtaaaatgctcatccagcagatgcttactcacgctgacacccaataaacgcatcagcgtactgtattcatattcggccggaattatacttgcggcatcacctgcgtgggtatcgtcatgcctttggtccgtcatatgcttacttcctcctaatttcaattatgcagagaatcaatggccaatacataaaaatcaataacagccgggaccaaaaggttctgccgctttacgcctatccttgttcacattgttctgtttgaatcataattataatccaaattaagaaaaaatacaatcgcttatgacgatatatgctctaaatgatttcttaatggcataacaaagagaaacccatatattgcacgcttccggcaagatatcggtttctctttcttctctaaaatataatcatccgttcagcgcacccatatacttgcgccaaccgccatactccgtaatttccttcatccctttcaccagctcaggttccccaattacccccagaaccacccttccgtcatccagcttaaccttgcctactgataatccctccggctccttcaagagaacggacacaaagcctgcggcaggaaccttccacacttccacgtccaccttacctgcctggctgctttcagggtcaacccgaatcatggccggatttctgtcacatatgctccagagtctgtaacacttctcagtcctggcctcaaacccgaactcagcccctgcctccagtaaattcccctccagttccaatccgcgcataagcgttccgtttactgctaaaagaatatatttttcccgtgtatcatctgccatattatctgtctcctttacaccctatcacgttcctgtgatgttttttcttcccagcctgaaacggctggccagtcccttacctgcgtccaagctgccagaaagcaaccgcgcttgccgcagcgacatttaaagaatcaacgccgtgggacatgggaatgcggaccgtgtaatcacagccggcaatggtacctgccgccagcccatccccctccgtccccagaataatagccagcttttcctctgacatcaatcctgaatcatcaatactgacagaatcatcatttaatgccatggctgctgtcacaaaacccagctcatgcaaaaatcccatcccctcccggggccaggacagccggctgtccagaaaggtccagggaatctggaatacggttcccatgctcacccgtatggcacggcggtacaaggggttgctgcaggcagacgtcagcagaatcccgtccatattcagggctgctgctgagcggaatatagcccctacattggtgggattcatgacattttccagcacagcaatccggcgcgccccggcgcagatctcctctgtcccgggcagaggcggccggtacattgcgcagagcatgccccgcgtcaggtgaaatccggtaagctgtgtcaacacatcaaattccgccgcatacacgggaatatcaccgcagcgccttataatttcccgcgcctggctttccacatgcttcttttccatcagcatggatatgggaacgcagcccgcgtccagggcgcgctctatcaccttgggactttcagcaataaaaatgcccttgtccggttcatggcggtttaaaagctgcccctccgtaagccgggcgtaaatgtccagctccggggcggcaaaatctgttatctcaattatattcggcatatagtatctcctggttctcttttgtttttcctgttttccggcctgattccattacacggaataaagccttgtgctgccctgataattcttaattatagtatatagagccctgataatccatgattttatgtaaaatccgctgacagtatattattttatccccatgtctgccggatttggaaaagaagcagaaccatgattctccgcacagtacgtcctgaaccaccagctgattaaaatggaaaaagagccgggtaagcagctcttaaaattgtttcaacacaaattgtttcagcacattttcgcaaaaagctcatacatcaaacgcataagctccacaccgctcctgaatcccacatccccatattcagagcggaatatcccctgcatcccggcgtcctgacggcccacaacccggacagaggccgcaggataaacaggaaattccctcaaaacctcccgttcaaaatcatactccttttttattttccctctcaaatccacaaaaggaaccggcactgcgtctttatccggtttgcaggccagactccggggtgctctccctctcatggggacacccactgcatccattatatcttccataatgaagatcatctggtcaagcccccggaaaaataataatttttccacatggaatgattttacatatcccctggcaatcccgcctgcaaaggactggaggccaatcagaaacgtatatgtatattccgggtaacgccctccgtcgcggggtatatcatcctccatgattataaatttgtctatttctgccatggccctctcctgttacatgttaccctgcttatctgtacggtaattcctatctgtcctgtaattcctatctgtcctgtaattcatatctgtcccgtgattcatacccggacgctctttcctatccgtccagtgatacaggattatcctgattgcctcgtccccggtggacgccttctgtcctgtcagatagatacatgcctccttccactcatccggcgtaaagtcatctctgctgcgcaggatgaattccctcagccaccgttcttccacatgtatgaatcgtaaatctgacagatactcgcattttgcctttaaggccagatactctaataaggaacaactcaccatctctgtatctccttccccaaacagcaccagtctgctgatgcgtgtgcactccggcgttttcatttaatttaccccagaataatcattctgtggtgctttctccgtctgtggggtgaatcaaaaagcattcgataaggattttataggaaaatcagaggaacaatgaggcaaatttgacacaccaagaaaccggcaggtatttttttcccttcccggtcttgtttgctttgaggaaaataatatatgtatattgacgcagtccgccttttattataaaatacaaggagattgtatgtttgttttgtaaaaatgccggcatgataccacagaatgattattctgtggtatttttatgtccttggcaattctcatccggttcattaccttctcgtaatgtttcaggctggatgccacgtaaatccttgttgtctctatggaggtatgtcccagaatatccgccagatgtgccagatttttctcgatggcataaaagctctttgcaaacagatgcctgaaattatgaggaaacacctttgactggtccactcctgcctcccggcatattttcttcatggaatggcatatattgcttctgtccagacattttccgctctttgtcctgaaaatacatccgctctttataccggcatcctttgaatactccttaagctgtctgaccagatttttcggaaaaataatcaccctgtattttcccttcatatttatttcggcattcccctggtaaacagcctccacagtcacaaacggcagctcactgattcgtatgccggttccatataatacaagcatgaggaaatataactgggattttcccgtacggctggctgtttccagcagccgtctgcagtcctgttctgtcagctcccgcttctcatccatgtacattcttttttggaccttcaggaatttcaccttatgagcctccaatcccatacactttagatacgtgtttactgcggaaagttttccgtttacggtccgggccctgcacttccggctgagatacccccggtactgtatcagcaactctttgctgagacattcctgccccataaaatcaagcagctcccccacatcatgaaggtatttgcttatggttgattctgatttttcctcgccacgcaaatacgtttcaaatttggtcagcagcatttccttttccataaaatcctccatttcagtccggtttacaagttgtcattgatgtcattcaggatacagaatatccttttttagtttttatattgtagatcagatttatacatcaaaaaaccggggggttatttttatggaatcatgcgtatcattggtgaaaacatttacgcagatttcagagctgccggatcatcccagctgtaaagatgatatggaactattcagaaagccagtatattcgcatttttcgacttatttatatcagttttgtcgtccgttctcccttgtcaatccgcgcctctgcgtttaacgtaacataggtaacaaaaaccaaggagggattaacatgaactacgaaagagaaattagtaaccagcttcggcgcctcggtgtaaacaactcctatgtagggtttcgttacacaatctacggcgtcgcccggactatccatgaccccactttgctcgcttatatatccaaggggttatatgtggatatagcggtccattaccagacctcagtgggctgtgtggagcggaatatccgcacccttatcaatacgatttggctgcacggagacaaaaaactgctgaacgaaattttcaattttgaacttagccagaaaccccgcaacggggcatttattgacgcactggcaaattatatagcggtgagaggaaacggtgaggaaatgacaggctctgcatgtcagcagcagacaacctagcacttcctcaccgcataagaggccgtacagcctccccttccggacaaactgtaccggccgtgacggccgccgggtattacttcctgacgcggccggctgactgcagccggtttttcattcctcttcccgccaggttaataccggaaacctgatcacaccctttttacaggcctgatatacttaaaatactgttccggattataataaaaatacatgagccggccgggagaagtatcaaggcaataacctgtaccagcataatcaaaggctgccatcgcattttctatccgttcctccacactcctgttttcctgttcataatcaaatggcccgtgttcaaaaacaatatattcagcttcgggaatatcatccatgagcatctgcggaggcacttctcccttgtattccgagggaagccggactccccagcattctgagcgcattatcccccagccgcagagtctgccatccggatcattcatataagccatgatttggccgcttccgcagttagcctcgcttccgccttcgtcgtccagttttcccttgatgctgtctaacaggccgcagactgtctcatagtcctgtcccggaatgagattttgcttctgccagaaatcccagtacccgttgctttcacggtttttgatatacaaaaatttgtgagcgggtatagtaacaaaataaattttaacaccatctgctgattgaatcataccgatttctcctaatccgaaaaagtagcggtcaaacgcacttatctttgtacgcagaaccacaggcttaggatttttcctatattcactgggcgttacaccgtatgtttccttaaaagccctggtaaaagcctcatgtgatgaaaaaccataatcaaaggcaatatccagaagattcctctggctgtccctgacctcttttaaggcaaaggccagcttcctgagctgcagataattcctgaattgtataccggatatttctttaaacttcctggacgtataaaattcagaataccccagtctgcgggaaagaaaacgcaaggtcaaggcttcgtcattataacctttaatacactggtcaatttcatcaacaataatctgaatctgtttcttccactcgtacatctgtctgttcacctcgtttcaaccgctctatgactcattatacaaaaacaatgtgtctgatacttgatttaacttgccatccggcgtaccagatttatccattgcatttatttaagccactgcttttttcctcccttccccttctgaattataatacgtcttccgctgatgattcacaagccttaacaaacgacaggccgtgtaaatataagttttcgcttaatttcgcaaaaataataaaatttccccttgacaatactccaaaagcaaagtatactaaagaagtattttttataagattttgatttcacatgtttttgtaagtcattattcctatgatggtttacaaaaatatgtgatttttttattttatttaaaatcacaataaaatattaggaggtatctttcatgaacaaaggtacagtaaaatggtttaactcacaaaaaggatttggttttatcacgaatgaagaaaacggcgaggacatttttgttcacttttccggaattgctacagatggctttaagtcattagaagacggacagtccgtaacctttgacataaccaatggcaaccgcggcttacaggctgtgaatgtctgcgcagcataatattcaggatataaatggggcatattacaatatgccgctgcaccatatatggcggggagaaatccccgccatttcctattgaaggccccctgccgtgctgcagcaagacagggggccttttgtatttgtccggcggaaaatgtgttccgctataaacaaactatccaagccatttttgcagggtttcgatgagccgttcaacctcgatgggcttggccacatggtcgttcatccctgcgctgtgagcctttccaatatccgtggcaaatgcgttggccgtcagtgccagtacagggatggttttggcatcacttcttttcaccgcccggatggcttcagcggcctgatagccgtccatcaccggcatctggatatccattaagatgcagtcatatccgcccggctccgaagccaggaatttttccagagcaatccggccattttcagcctcatcaatgaggaatccatgcatcttcaatagttcggccgcgatttcccggttaagcggattgtcctccaccagcaaaatccgtttcccctctaagctggtatgtacttcctctatgggaatggcgacagcgtcggaacgtccgctctggcagaactggtggaaggtatgggccaccttggacctgaacagaggcttggtgataaaggcatctgctcccgcaagccggaactcctcctcaatctcagaataatcataggctgaaatgacaatgatgggcacatccatgcccaacttccttcgtatcactttcagtgtttccaggccgtccatttccggcatcttccagtccagtatcacagagaaaaaatcgtcttttgcctcatgggcgtctacaacacggcagaccgcttccttccccgacagcacccagctgcttcgcatacccagctcatccagaatctcagcggcgctttcacagataatctggtcatcgtccaccaccagtaccggaagcccggaaagctctgcgttttcctcctccgcctgtgagcccagttcaaaggagacagcaacaataaactggctcccctctcccagaacactcttaacctcaatggtaccattcatcatgcgcacaatattctgtgtaatggccattcccagccctgtaccctgtatctggtttgcctgaaccccctctgcccgtgaaaacggttcaaaaacatgggggatgaaatcttcaggcatcccaattccgttgtcagtgacaataaactcatattgtcccctgcccttggcaaaagacggtatctcccggacccgcagccccacacatccgccgtcgggcgtgtatttcactgcattggacagcaggttggtaagcacctgctgcaggcggttttgatccgttaccacggtttcatggcgcacatggtcggcgttgatttgcagctcctgatgcttttgtgctgccagcggcctgaacacatccataacatcctcgatcagctccggcagggacacagtctccgatacaagatcaatcttcccgctttcaattttagacatatccagcacttcgttgataaggtttaaaagatggcggctggaaacattaattttattcaggcagtcctgtatcttttccggggattgcagatttgcctttgcgataaccgacataccgataatcgcgttcatgggcgtgcggatatcgtgggacatggaggaaaggaagtttgtcttggcgtcagccgcaatccgggccgcattgcaggcatcttccagagccagtctttgccgggcctgttccgtgcgctcctccgtcacgtccacacccacgctgtaataggaaggaaccccatcccagctgtccttgccgtctacatagctgtacgtcattatcaaaattttcacggtcccatcccgggtgacaatacggctctccgcagctgcggactcgcctgtctccctggcctgccccatggaggcagcgatacgctccctatcgtccggatggacataatcccattgggattgcagttcctgagaaaattgttcttcggtatagccgatcaaatccagaaaacccacgctgtgccagaggaccgtccgcatatcccgtccgtccacccgcaccagcccgccgggaacgctgcggatcaacgcgtcgcgttcctggtcctttttcgccagcttatattctgtactgtacatatcatgggacagctcaagccgcgcccggtgtccctcccagttgataatacggtttttgattaaaaaggtccgcttcaaaactggattttggaattcccattcataaaactcatcctcggtcagtctggcattggtgcaaaaggggcagggggacgttctcccctggatcacctcgtagcacttgcggcccactacctttgcagcgggcgcgcccaatatgtcacaggaggactgattcacatacagcagctcataggtatccatgtcgctgatgtagacataaccctcgtaggcatccatcataaagcggaaatactgaagtttctgcctgtagagccgctcctgctcctctttttcagccatcatcctgtccatccgcgcaaattccgcctgcaatacgggcccggccgctccatcctcttctttcatggtcccataaagacaggcccaggaatatcctccctcttttaggggcaggcggacgggcagctcaatatcagaacagttcttctccgcagcctgcgccaattcctgacggatagaggcaaacacaccggggtaatccgcataatactgccggagatcacgaaaacagccgaaaaagctttccctggtatacccaatgctgtcaaaaaagctggaattcccccactgaaaggtcagatcctcatccagcaggcagcatagcatacccgtcttcagcccgtccatcgctgcaggacattctccctttgccctttgaggcatataaccgttattgcgctccgtcacgttttccatgttttaaccgcccgttccaaatataatctctgtgtatctatttttattttttgcaatcatgattggggttttctggcagaccgccaattgttcatatacacatttattttttagtatagcaaacaacattacaaatagcaatagatcgcacaattacttatacttggaaccattcctttagaggcggacagattgtgtaccgatattcaaatactccgccgcggtctccggagggaccatgctgccgccggttgcccaggcgatatggacagcctgccccatgcagtcactgagattcttttgcctgatataaccatccatttcatctgcgtggaggaatgccgcaaaggatgcgcatgcagatggttctataaatatatcctctgtctttaagagggcgcgcatcagttcatacagctttctgtcctcgatggtgcagattcctgcaagccgtttctcaatcacctttcccacaaatgcggacggccttcccacggcaagtccgtctgcgtccgtctttccgctgataccgaagtccctgacgctgaccttgtcatgctctcccgtagccattcccaccagcatacagcaggcctgggtcggctccataaaaaagcagtgaacacagtcgccgtatatttctttcagtccataggccaccccgcccggcgccccgccaattccgcagggtaaatatacaaataacggatgccgcctgtccacctggattccctgttcctccagctggcgtttcagccgctctcccgcaaccgcatagcccaggaacaggttgacagaattctcatcatccacaaaataactcatagggtcccggtcggaactctttcttccttcctccacggccgcacagtagtcggactcatattcaataaccgtgacccccttgcttctcagcaaatccttcttccactgttttgcatccgccgacatgtgtaccgttacctgaaagcccagtttggcactcatgatgccgatgctgagccccagattaccggtggagcccacctggaccttgtaccgtccaaagaactccctcatctcactggtgttcagtttccggtaatcctcctgctccgtgagcagccctgccttaaaagccagttcctccgcatgtttcagcacctcgtagataccgcccctggcctttacagaaccggatataggaagatggctgtccattttaaggaacagtcttccggctatcccggcgccccactcctggttcagttcctgcctcatggccttgatttcccgcagctccgattcaattatgccattacatgcagccgtctcaggaaacacctcggccagataaggcgcaaatcgttccagccgccttgccgcatcctgtatctgctccttagacactgctttttccccctgccggctctccgggcactccctgccgttcacccagaacacttcttttccggcagcagcctccgccaataccggtatctgtttcatatatgcttctattcttgtatccatactattaattcctttctgtctgtaagtttatattctctgcgctacttatggttctccctgaaaaattctgctgtcagcttcatcaccaccggtgaaagcttaagaagggccagcacattgggaatgattaaaagccccagcatacagtcctggaccgaccacacaatcccggccgtgctcaggcttcccagcaaaatcaataccggaaacaggatgcggtaaaaacggtcccccttcaggctctttatgtacatcaggcttacatgcccaaaataccactggctcatgatggaggtggatgcaaacaatatcaggctgaccgaaaccacatacttaaaaagaggggacacagttccaaatgcctctgctgccagagacgccgcgcttgccccttccagaggcactccgcttgccaggatggaaaaaccagtggtgctgcagatgaccatggtatccacgaacacctccacaacgccataaaagccctgcctggccggatggtccacctgagccgcggaatgaataacggccgctgacccttcgcctgcttcattggaatacagccccctggccacgccgaagcgcatggcctccttcattgtcagtcccgcagcagctcccatgcctgctttcatggaacatgcttcctgtaaaatgctttggagcatgggcagaatggaatccagatgagtgagcaccaccacaatacctcccgcaatatacagcgatgccatgaccggcacgattttctgggccgtatccgccagacgtttaagcccgccgcctataataaaaatcatgacagccgccactaatatccctgtacacaccttcgggattccaaatacctggaacgccacatccgatatggtattggactggatcagtgtcccccctgcgttctggaaaaacaggagcacagccgcggccgcgccaagcaacggcgcatggagccccttttcaatataatacatgggtcctccgtaatagcttccgtccgcacctttctggcggaacaccagtcccagtacaatctcggcatacttggtggccatgcctaaaaatgcagctgcccacatccaaaacagagcccccggaccgcctccaatcagtgcagtggcaacacccacgatatttccgctgcccacacagctggcgattgccatatatagcgcctgaatggatgatactgtgcccttatggtcccgggatgcctctgctgttttatcttttctacaaaattcctttataatccaggggatggacctgaactggattccgcctgtggctatggtgtaaaacgctcccagccccagcagcacaaacagcatccagttcccccacagcaggccggccagattccccagtactgcctctgctgttttcatcacttcaaccggttccttccctccgcctgcggcatctcaaatcccataacggctgccagtgtgggcgctatgtcaatcagcttcatggaccctatgtcgcaatttcgttctatcccgtatccctcaatcatgaaggacgccctcatctcctcaaaccgttcgcaataaccgtgctgggctttctggtgcagtgtttccgtacagtaatccccctctgcgtcatcccgtatttcataccccttccgggaaaccagcacatagtcagccagggggaaacctcccctctcgatggcctgctcccggtccagcacctccagaattccaaaggccggatcggatgacagctccttcattacctgagccagccgttttccggcgtcctcatcctgtccattttttaaccggatttcggacatgccccctgcgcgctgggaccaggctctccagtccgtcaccctgccgtttccatctgtggtgataagtcctgcttccctcagctttacattgggacggatattgtaccggttatccagtgtcccatggtcggataccacacagacaacggccctgtcatctgtcatactatgtaccctctcaaccaaatcccccagcatcctgtcaatggcctcaatggcatgggccgcctctttactgtacacaccatactggtgggccatctcatcaaaggatgcaaaataggcggacatgaagaacggacgttccttagtccttggcgcaatcttatggtccaatacccacatagctgcccggtatctctgtctgtcccctgcttccgtcaggtccagtcctcctgcataccttccaatgtccttttccatctccagaatcatgccctggggcacggacatggcatcaataaaacggctgtcaagctctgtgccgtcccaccagaattcaggtgcaatgaagtctccttcggcagccacggaagtgggaaaagccacgctggcagacagatatccatgttttccggcagcctcccacagattttccacctttctgctggcaaaccagtgccacgctcccatatgttcacccaaggggtcaaaaataccattgttatatataccgtgggtagccggattggttcccgttatgatgctctgatgacagggatacgtaaaagtaggaaacacactctgtacgcctccgcctgcaaatgtaccgttctccacaaaatatttacttatattaggaaggctgattcccagacgttcctgttcaaaaacaaactccggttttaacgcgtccacggataccagcaatacgcttaccttatttctctccatatccttcatcccccttaattttccggtttctcaacggaaatacccgcctgttcaaacggctgtatctgctcctttgttgcatcagaatcagtaataatcatccccacccggttaatatcacacatcttcaccagggaattcactcccagcttggtgctgtcagcaataacaatggtctggtctgacgcttccatcatcttttcctgcacaatgatttcatccatgcgctggtaggtgattcccctgtctaccgaaataccgcaggtggtcaggaaaaatgtgttaatactcaatttggaaaatatcatacctgcaatgtcagacacaaacgccatctcctcagggcggtatacgccgccggtggcaatgagcgtgattccctttgcatcggccagctcatttaagatggcaatggaattagtaaccacggtcagggaatggaacgtcctctttatgacgcgggccagctcataagcagtggttcctgagtccagggctatggactggccttctttaatgaagcggaccgcaaactctgcaatctccaccttgttttccagattctctctttccctggctgaaaaattctgatattggatggtcctctccccggacaaatcttccttgtcagccagaaaagcgcctcctcttgtacgccgtatcagcccctgggactccatattctccaaatccctgcggaccgtttcaggagaaacccccatcttcttttttaaatccgcaaccttgacgcttccgtccgtctgcatcaggcttataatcttttgataccgttgttccgccagcatccgcatacgctcctttcttcccatcagtcagcttgttttgacttctcttaactacttttaactcataataacacatacaagcacactattcaaccctttttatccgcaaaatagcacaaaatcacttatgtgtcttcgtgtattttccacaatttaacccattttagctcaaaatagcttgacttcactcactttgccacatatactgtgtgtacggaaacaaccaaacttaacagaatgaaaaataaaatcaggagatgaaaaaatgaaaacaattgcagacaaccgtcaatcaaaaaagtggatttcatttggaacattggtgctgggcgccggaaccatctacaagctggggtttttaaaggatgcgttttatgttcccatgcaggaatttatgggactctcccacacacagataggtacagccatgagtgtggccggattgatttccactttcggcttcctgttctctatctatctcacggaccgggtgtctaaaaaggtcatgattcccatgtcgcttatgggcatcggcttactgggcatcggcctttctaccttcccgccctactggctctttctgttaatcaactgcggcctcgccgtctgtgcggacatgctctactggcccaccatgttaaagaccgtccgtcttttaggttcagaggaagaacagggccgtatgttcggtatcatggaagccggacggggacttgtggacaccgtcatcgcctttggcgccctgggcgtcttcgcactgtcaggaagcaatgcggccagcctgaaggccgccatccttttttactcggcagtacccatggtaatcggcatcatcgcttatttccttcttgaaccggacgagctaaaggctgtcaatgctgccggagaaaaagtaagcagaaacaaagctgccatggataatgtaatgctggcccttaagaacaggaacatctggctggtatcatttaatgttttttctgtgtattgtgtttactgcggacttacgtattttatacccttcctcaaggacctgtatgcaatacctgctgttttagttggcgcttatggtattatcaaccaatatgccctgaaaatgctgggcggtcctgtgggcggctacctgaccgataaggtattccattccgccacaaaatatctgcgcgttgtatttgttattacgggaacagccctggctgtctttgcgttcctgccccacagccatatgaacgtatatttcggcatgctcatgaccctcagcatcggcgcctgtgtattcagcatgcgcgccatcttctttgctcccatggacgagattcatgttcccagggaaataacaggctctgccatgtcgcttggttccttcatcggttatctgcccggcgcgttcctctactccatctacgggagtatcctggaccacaatcccggcatcagcggctaccgcattgtattccttatcatggccgtattcgccggtgccggattcctgctgagcagttacatattaagtgtgattggaaaggataaggccatcaataattaattcctttaacggccagcactccaccggataccccgaatacaatgttcggggttccctcgtttttaaggacaaacccggccatgctgggtgtaagcgtttcctcttctgctgcctccactgccgccgacaattccggtgtgaatatgcggtctgtgcccaaagcagccagctcttccggcgaacctgccgacacgcctccgtccttaaagcccacatacagaggataggaggccagggaagacaatgcatccatgtcccggtccgcaacagctgcttttacctttttggcaaacgcggttaccgcttcctccggcaccatgaaattgtccgtataggctgttttgttaatcccctcccctgtccggcctatctcaaactccaatttcccataagctccgggggcaatctcatatttatcaaacacaataaccggatttccgttttcattcatgtaaaacgcggttttatccgtaattcctgtaaatccgccttctgagccggaccagaaggcaataccgtcttttttctttctatcttccatctggcggagtatgctttcattggcaatccggacatagtcacggcccaggacatctgccagcgtaaccatcttataatccttcaaatcaatgttatagtatcttgtttcactgccggccgcggaccagttctcagtttcctgcactgcaaaggaaagatacctttctgtctgggccttgatttcatatcccacatggattttaatatcatgcgcttcccactcctcctctgttcctcctgtttccatgaatgccttcttatattccctggcgcgttccgctgcctcttcagcgtaccggctgcacaaatcgtatatttcctgattcagagcagcgtccagcccatttgtatcctttgctatcatctccacgctggggatttccacagatatcttccagtccccctcatccttctcataagacctgaaggtaagaatccgcgctgcggctcctatgacaggaagccctgccgccatatcagcaaaggctgtatttgtgtttaacgccgtagtaaataccagcacaagggctgctgccgtaccggcacataacccccatatcctgtttcttctgtatatcttgtttcttctgtatatcctgtttcttctgtatattccggccactggtattttttgctcctgactcttccgcttttcctctgaccggacaatggctgccctgacccgtccggacagttcctggggaatcggtatctcctcatacttttttcttgcatcttctatctgtctcataaatccgcctcctgtatattctgttttaacagtctcaaaccacggtataatttcgccttgaccgtattcagattggtcctggttacgtaagctatttccttcagcgtcagctcctcgaaatagcggagctttatgatggtctgcacatcctcctccagccggtttaactgctcatacacatcttcttcccggttgtatccttcctcataatacggtatctcctgccctatcccatcctctgcgggtatctccatcttctgcttcctgatcagcagcaggctctcatttacaagaatacggtaaaaccacgtccttacggcattttcatttctgatggcctcatagtggtccaatgccttgcagacagcgttctggacaatatccatggcatcttcctggttatggacatagctgtaggccagtctgtaaaatttctcctgattgctgactatatagtccacaattctgttatataaatcttcattcatggggtttgcatccctccttgcggtgtagtttcccggtatatcataacggtacatcatagcgggtgtatctttgtttctgatatatagattctgacttcgttccaaaagttgcatatgattatgttttttaaccataaaatataatcagggcaggaatcggatgttttaccgattcccgccccgcctggcagctgtcatttactgtccttttccttttatatggttcctccccggattgctgccatacgttccgaggccgtccgcttcattggttttaccgagtacaggcagactgccccagtcagtatgtccgccagcggctgtgccagataaattcccgtaacgcccattattttgggcaaaatcagtatgaatgggacataaaacagtccctggcggataacggacaaaaataaaccatatctggaagaaccaatggtctgaaatgtaattgtcatcatgtagcacagtccaaaggccggataaagggccacctgggaaatcaaaagcctggccccgtaatcaatgacggccggattcctgttaaacagcataatcaatggcctggccagaagaatatagattcccgccaccagcacggtaagaatcagggatgtccgtaatgcaaagcgaacggactcatgaaaccgttcctccttgttggcgccaaaggagtaggaagcaaccggctgatatccctgcatgaaccccatgactacatagcatccaatcagcacaaggcgctggaccacaccgtatgcagctataataaggtctgcgtctgtcatggactttgccgctatattggtaagggatgttgccgcagcaaggcagatctgtataacggctgttggtataccgatgagcgtgacggacttgatgaaagaccaccggggtttaaaatactccctctttatttttatgatggaacgtccggacagatagaaccagccaaggataaaaaatgtgacaaactgtgatactgttgtggcaagggaagccccctccactcccattgccaatccccagtcaaacataaaaacagggtccagcaccacattaagagcagcacctgccacaacagcgatggatgagatttttacagatgattccgccctggccgcgcagttcatactctgggccggaagattggcaagggccgccacaaacatccagaatgcgtaatccccggcctggggcagcacagcttcggaagccccgaaagcccgcagtaagggctccatgaaaaggatgcctgcagcgcatagaaagattccaatgaatacagataacccaaccaccgatgtgattgtcctgtttgcctccttcttatggcctgctcccagctgtctgcctgccagaaccgctgcgcctgccgcaaaaatattttccaccgaaaccataatgagcagaagcggcaaagtaactccaacagcggcaagggctatatccgaacccagcattccgatataagctgtatccacaatattgtagacggcctttgccagcagggccagggtggccggaactgccagtctggtaatggccctggagggcttcatatcacccagtacggattcctgccctgtgttttccttcttcatatccccacatcctttcgctccgccgcacgttccaccacaccatagagcagcacatccaaggctctcctgcaatcctcttcatgtgtgctaaaatcaatctcccgctccccggatgtctgatatttcgcattgacataatcctgaaactgcaggaatatatccaccaccgtctcccgcgacaccccaaccctgagcttaaggggctccagtatccggttcaatatggagatattaagtttgtcaaacccggacttgctctgtctgacagctgattccagatgggccggcggcataatgactgcctcgcagaaaattctgcggtacaagggaaataactgaaaaaattcaaacctggcatcaaaataaagctgcagctgtctgtggacagtttccccttccaatataagcttctctcccagatattccgtcaaagcccggaagcactcatccacacaggccagatacagctcatccttggtctggaaatagtggtaaatgattcccttggacacgccctcgcagctgcatatattattaacggaactggctccatatccctgttccgcgaattccttcagtgcgctctccataatccggcgctttgtctgttgatttttctcttcccgcttcatgaacattcctccttaaattattgaccacccggtctatttacgataagaataccataaacagaccgggtggtcaataatttaaatctgaaatatttataatctttgtatccgggttctgcatcgttacagtatccccttaaggatacagaacatcctcataaaagaaaacctgccgtttcccattcttctttgcagcatacattgccttatcagccgctgaaaacagttccaaaaaggtatttccatcagcaggagcaagcgcaaccccgatgctgacactcaggggcggaacacccgtttccaaacaggattccaaatgcttttgcagaagctccgcctttttttgagccgtcctgcggctgttgatatccgatacaaagaccgtcagctcatcaccgccaactcttcccaggacgtcaccctcgcggaaggtcctccgcatgcagtcaccgataaagcgaagcgccatatcacctgcgacgtggccatacatgtcattgatatgtttaaaaccgtccgcatcaatgatgaacagcatgcctctccctttttccatcagccgctctgcaatctgtttttctgccgctgccttattaagaagccctgtcagtccatctgtctcagacattctcaataaccgttcctcactgcgcatatattcatcaatatcagtaatctttccaataatagaatccaatactccattttcataaagatactgatattgtatcatacaccaaaaatactcatccgtatcaggacgcatcagccgtacccggatttcacctgagggagcatctgcctgtccgtcaagcatccgcctcactactatctggtcaccagcatagacataaatcagattcagctgccccggtccgttccccttctgcattaaatcatggacacggaacaatttaacagagttggaggtaaaccggatgatgtcacgcctacagtcataatcaaacagcactgtatccgaaaaacgttccagaaggaggtaacgctgttcctcaaaagaaaacctgcgctgcattttcctaacaaacaggataatgatcgcggatgcaaggataaccgcagtaatcaggactgcgatgctggccgctgtgctatacacgatatgctgggaatgggcaaacgccctgtcagccttcagacagacaaccagatgccagtcattgtattttagccctgtcattgcaatgtagtatgggtttccgtcaaagatgccgatacggatgctctttgcctgcttatcatctgaggcaaaagcggcacgcagctcatccatggtctcctctttgatgccccaggtccgcatcatgtccagcagacgcccggtgtccgcgtttccctcctccatacggaccgggaatatcctgctgtcactgtctgtcaggaaaacggcggcaatctctccctgggacgggttatacagctcggtggaaaccagagtctctgcattgatgactccgcgcacagcacctataaacttcccatccttactcacaggcacaccaataccgatacagtatacgttacccatccgttcagagaaggtgatttcagacactaccgtttccccgcgcatcagccttgccagcgtgtcggatacctccggccgcgcagtaccatccgctatctgttccttataatcctcatagctgtaaaacgagtaagtgacctcctggctgtcctcattgagtgccaataaatatgtactgatgaaggcagggctgttatcccttccgaacagaactgccatggaatccaatgtgctggtgattccggcaatttccaggagcgtgctctccctctggccatccgtataggcgttgagagtctcctctaccatacttctgaattcctgttgggtctggccccggttcataatcaggacaccggtgatacaaacacctaaaaaaacagcacacgacagaatgataagcagatagggatggggccgccggtgcccgggccccccatcccccggttcccggcaggctgttttcctttccttcacaggcgcaagtgagtccgggagaggatacctgccgtcaccatcctctaacatccggaacaactgcatgggcggcattggctttgaaaagaaaaaaccctgcaccgctgtgcagcccaaccggagcagacagagacactgttcctgcgtttcaaccccctcgcacagcacctgtacatggagccgctgggctatgttaatgatattaggcatcaatgcctcgttacgttccctcatggatgggctgtctgagaggaatacacggtccatcttcaggcagtcaaagttcagctcccgccagactcctattcctgcgtaagcggaaccaaaatcatcaatggtcaccttatggccataagcgcggagctggtcaatcaactgcttggcaccggagaattcctccagcaggatggcctctgtcagttcaaactccacaagcccaggcggcacatgatactcctccccaatagcatgaagcttatccgctgctgcggggtcccggatatgcagatgggacaggtttaccgagatagggaccacgggcaatccattcctgattctatcagccaggaacacgcagacctgccggcagatataccggtccagttccataaccgccccgctgttttccattgcttccaggaacgtatcaggaaaaatgagacttccgtcttttcccatacgtctcgccagcgcctcagcccctatgatttcaccgctgagcagattcaccttgggctggagataaaaacaaaaccggttttcctgcatggcacgataggtttcgctttccgcctcatactgcgcgacagtccgtttccgcatggcatcatcatacagcactgtgttggtggaaaggcactttttggctgtcttgcgcgccgtgttggcgttgtcaatcgcctcggttaaatcatcgtccacccggcaaatgccgcaggcggctttcaggctgcaggcaggatgccgcctgcgccacccgtcaagaaatgcctggattttcacatcgctgccacccatgacatcccggatatctgtttcatcatccaaaaagaacagcccaagaaataaatccgcaaagggcctttggcacagacgcatattcggccaccctgtaagtatgtcccccaaacgcccaagcagttcatcacctgcctccgcaccgtaaaaatgatttaccgtgtggaagttagtgatatccgctaccatcacataaaatgtccctccatcaaaatccccatggatgatttggtctgcctgccgtataaaatcctcatttggcttcatatgtaaccctcccctgcaaaatgaaacagcaatcagcggcagccttgcagctcagacttactgctgttgcggacccaggagctgttcaaacgcctctgcctgcatcgggcggtaatagtaatagccctgggcaatatgacagccgatatcctgaagcacgtctacctgcgcctgcgtctccacaccttcgcatacaacctccattcccagctcaaaagccatgtttaccaaattttcaatgacaatccgctcccgtgttccctgaagtccggcacacacaaagctgcggtccagtttgaggacatccgccctcagcctttggagctgccccagcgaggaatatccggaaccgaaatcatcaatggcaatctgaaatccatgcatcttcagttccgtcagggcggaggccacactctccggtgcgtcggcaatggcactttccgtaatctccacctccagcagatgatggggaatccggaatcgatctgcaatttcagaaacctgcctgacaaacccggcatgtccgaaatgcatctgggagaaattacatgagactgtgacaacggaaagtccatcatccagccatctgcgcaccgcgcggcataccagctcaaacatatgaaggtccacgcggacaataagccccttcttttcaaagaacgggataaaggaccccggcatcaggagcccctgttccgggtgattccagcgcaccagggcttcgcagcccgcaatccttcctgtgtccatgtccacctttggctggtaatatgcctcgaattccccctgttccatggcagccgccagccttccctcaagcccctgttcaagcagcgccttattgcgcatctgctcatcatataggaaacagcttccgcctgccgcggttttggcgctgcgcatggcatagttcgcaaagtcaagcatctgtttaatgtcattggtttcgccgtcctctgcctggtaaacaccaaaggaaaccgcaatctcataaggtataatgcccctctcctcacgccatctgttcagttccgcctgcatatacaccaaacgggcagcaaatgtttcccactgtttgtattgcctgagcatcacgaagttatcagccgatagcctggcgcagcactccctgtcccccattgatttctgcaagatactcccgaatacacggaggacttcatctccttcctcaaaaccaaaggtatcgtttatcagcttgaaacggtcaatgtcgcaatagaccaccgcatatctccccgacgtgaggaattccttcacccggacatagaaacggtttatattatccaatcccgtcagctcgtcccggtagagcagatcctgtatgcgccgcttactgcgtgatatattaaacagattgatgcacagcagcaggatgatgctgccggacactgctgccacaagtcctgttatcagccagatgttctgatgtacaaacgcttccagggtgatgggacggacagaaatggagttgttcagcagcagggtatcaatctcttcattggacatatactggatatatttatctaatatggaaaacagcctggggtcggctgatttggatacgccgatgcagaggtcgtttgggtattgggtcagcgtggtgacatgaagattttcatatttggggtcgctgagaatataattcgccgtctgtgtattggtataagctgcctgtgctttcccttccaggagcgcgtcaaaacacgcctgtaccgagtcatagtaatagatttcttttcccggattgttttgggccacatgttcagagagctggtatccctccggaagggccagcacctttatctccggtctttcagcctgggtaatcattgcactgggcgtattcaggaaacgcagcgtagtgttcatatggttgcgctcatcccatagataatctccgtccaccacagagatggcatcggtctcaccaagtttcagtgcacgcaatgccatggacgcagggcaagcttcaaactggaattccagcccgctcttctctgtaatccgggcaaaaatatctgccataataccgctgaattcaccgtctgcattttcatatgagaggggggcaaatgaagggtcgtaagagatatgtatgggttctttcaccgcctggatgtattcagcctcttctctggttaataccggaatctgattggcgcttggggagagatacttgtcataaaggtcggtccggtaatcgggattgcgcaaaaggatgtcattaatggaccggttaatctgtgccagaaggtccgggcgctgcttcgagaccgcaatatacatgggtgtcggagcaaaccgggcaacactgcggaatacactgctgcggcccaggtgggtaattgccacgccatccagagtcccgtttccaagcgcgtccagcagtttctgtgtctcatcatattcaacgatagtgagcgtgacactgttttccgcgcagtagcgcttgaaactttcgccatcctcacccccctttataatccctactttcatcccctgaaacgcatcaaagtcctcataattgtaacggttatcgtccatccgcacattgagggtagtataaatggtacacatggactcatccgtaaacagcatctgatccatgcggctttctgtgcggtatacagcaggcagaatgtcaatcctgccgtcaatcaaaagccggaacgcttcctgccagctgggggaatccactacctcataagataatccgctcagttttgagacttcctggaggaactcaaagttgtagccctcatactccccttgggcattatgatacatgtaatccccatcttcataataacctacgcgcgcagcagaggccgactcccctgcggatacgtccagagggaacaggaatacaatgaaaagaaccgccatcatcaatactccgcccattccttttacctttgtctgcatatgaattcccccctcaacggcttggctccattaaaaatacaaactatatctttcctattttagctataggcttattttaacacatgtactggctaaacgcaatttgatgaatggggaaaaaactgatataatgtaacaagaaagggttatttttacaaaggtggtgaaacagattcagactttatatgattacctctatcagatgctcatatcccagttcctaaacggtaccttccggccggggcagcctttcccgtcccagcgtgttctctgccagcggtataacgcaggtataaccactgtccgcaaggtgatgaaaatgctggatgaggaggggtatgtccgcacagtaaaagggcagccgtccatcgttacctaccaggcatctccggaaacatacgcagggtttctggtacagggccgggatgaaatcgctgatgcctacaagggcctggaacttcttatgcctattttttaccgcgaaggcgcccggcggtgcagggcgcccgaattaaggcttttacatggattggcagaccacatatcagaccatatggagcatgaggaactttatcggcaggcccatgccttttatgccgttctgctccgtcctttgaataaccagctcatcatggatttggaagttgacagcgaacattttctttataccccatatatccctcttcccggcacaaaaaatccttttaccttaaccgcagcacgtttaaaaaactggatgtatgatgccgtgtgccagattgagcacaggcagtttgatgacttttataataaaattgtgaatgattaccgggaatcagccaaaagagttgacggctatcttcactcattaagcaggcacatccccgcccctccccaggtcacacgggaaatacattggtttcataccaaaggacgctctgagctgtatgccagattagcaatgaccatcatccgcagaatcgacagcggggaatttgactctcaaaaatatcttccatccattcccagattgatggaagaatatggcgtaatgaagaatactgcaagcagggctgtctcccttctcaatcaccttggttttgcccggacacttgataaaaagggtacggttatagcaatcaaagagaatactgcaggcagggagaacattgatctggcagcccccatcatacaggaacggctgactcttttcatgaacgccctccagattatatcccttaccgcacgcaattgtgccgcatctttttcttccataccagaagatttgctgccatttatggaacgccgtcttatgtacgcaaatgacagccgggttagtcccttgtcgattcagcctataatgaaatgcttcgtccaaatgataccctgccattccttaaaaaacatttttcagcaaatggaggaactaatcatctggggatattatttacaggcggttgaccctgcgttttctcctgattcctgttgtgcggccaccgctatgaaggagcttgcggccgccttaagaacccgggaccaggctgttatagccaatgcttatggcaacgcttttacactggtttatgaagatgtctgccggattgtttcccagatacccggttgttcctgcctgcttccggacagacaataaaataatcttccggtcaaaacaggccggcagcatacgccgccggccagatacatacaacacatatatactgcctgtctttatgaaagatccgctccccgtccccttctgcctacagtaactcaatagagaatatttcttctgtaagagactgtcggcaggtcaggaaccgtcctttcgattacgcggtattgaaggtttgcaggttggaactcaccggcgggcataggcccggcaaaatagcagccctgcccgatgtacgtcacgatctgtttagatatttacgaatctcccgtccaagcaattcaaaatccaccggttttgacagatgcccattcataccggcggcctttgcgctctcgatatcctccacaaaggcgtccgctgtcatggcaagaatggggatggtcctgccgtcttctctcgaaagggagcgtatggttcgggccgcctcatacccgttcatctcaggcatctgaatatccatcaggatcagggcatagtatcccggccggctttcacgaaagagccggactgcctctattccatttatcgctgtatccagcttcaagccgaatccttccagaagttccacggcaatttcacggtttatttcattatcctcagccagcaggaccgtgaccccggtaaaatcaaaggattccgctgcctgctgtgccggttctgtatcaaacaggtaccgtttgatacagtcatgaacggcggagtggtaaaacggcctgtccaaaaatccgcatattcctaaatcctgcgctttctcttttagttcgctgatatcatatgcagacaaaatgaaaggggcgctgctctgaaatacatggaggaacgcttctgccttttttagaacctccgctccaggcagtccggagcccaggataacaagatcatatgcttccacctcttgctttcctccgtcatacctgccggcggcttcctcaaatccggtaccctccaccctgattcccatggagagaagcaaccggcatccccaatccagggaaacaggatcatcatccaccagaaggacacatattcctccggggtccgggcctgtctttgccgtatctggcagggcttccatgggcaggaataccttgaatgctgtcccatgtcccggccggctttttacggttatatctccccccagcagatcggtcagccgctttgtgattgccatgcccagaccgcttccttcaattctgtcggtacggctgtccttctcccgggtaaagggttcaaaaatatgttccagatactccggtttcatccccatgccattgtccaaaatcgtaaagcagagaacggctttaccgttttcttccgttctccctgcctccacctccagtacaattgttccgccatttggcgtaaatttaatagcattggacagaagatttaaaagaatctggcggaggcggagcgcatcgcaactatatgtttctccgtggagctcttttatatggacatcgaacctctgctgccgcgcgcggatttccggcagcacaatcatgataacctcatgcagctcatccggcagaaagatcggcgtcatattgatggggaaattcccattttcaatttttgacatatccagcacgtcgttgatcagtcccaggagatgatggctggacagacggattttctgaagacagtccctgacccgttccttatcctcaatatgcgcgcaggctatctccgtcattccggtgatggcgttcatgggggtacggatatcatggctcatacgggaaagaaagtcagattttgcagcattggcacatctggccgcttccagcgcttcgttcagcatatccgtgcgctcttccagcttgcgctgaagctccctcagttccgtgatatccgtgatatcaataaacatggttaagtataccgggtcgtcggaaaccgtatcaatacaggtgccgttgatatggaaccatcggtcacggccatgcttatccctggtatgtatggtggcttccagaggctcccttcttctcaggacaggcatccggcttttaatcagctcccggctctcctgcgccagcacggaaaaggggtctgcggcttcaatatcgtcccggcttacatcaaaaatatcctcaatctgttcgctggcgtccagcatgacaatgctctggggcaggatacggtgcttaattataaaaccaggtatactgtcgtatgcaatactccgctccttctgcatctgcattaagttggtcacatcaatcatcgtggtataagcaatctgccttccgtccatatattcatcggtcagaaagcccaccagtttggcccagagcatggaaccgtccggttttttcaggggcagatatgcctcgtagcttcgttggtcggcagataccattccccataccttctcattcaatattttcaagccggcttcattgtcccggaaatactcgtcacagtgattatggaacttagtctcgtattccgcctgggaatatccaatcagccggtaatagaattcgttggcccacagaaccgtaaaatgctcgtccatcagatgcctgctgacactgaccgccatggaactcatgagcatttccagctcgttcctggtccggaccagatccgtaacatccgtcataaccgtataggatacacggtacccgtctatgtactcatccgtaaagaagctcaccagcttgacccaatagctggatccgtcctcgtacttcatgggtacaatggcctcatacccatccccgtcattctccagtacggatgtgaccttgttggtcagcagttcccagccttccggattattccgatagaactcgtctgggtggttatggaacagcgcttcataccttgcttttgaatagccgatcagtttgtaatagtattcattggccaggacacaggtataatgctcatcaattaaatgcttgctgacactgatgtttaaggcgctcatgatcatggcctgttcctgcatcatcttgtcaaaatcctgccgggtttcctcttccgccctcctggcctgcatcatatccgtcacatccaccatggttgtgtaggatacacgatatccgtcaatcagttcatctgtaaaaacagcctgtatccggacccagaaagtcccaccgtccgggtaaaccatgggcagataaagggagtagccgcttttcccctgctccagagcagaattaaccgtttcgaccagcttcgcccagccttccggattattataaaaatattcatcacagtggctgtggaacagggcttcgtattggggcttgggataacggattaaatcatagtaataatcgttagcccagatacatgtataatgcccgtctatcagatgcttgctgacacttgcccccaaaacactcatcagcatgctgtattccgcgttcagctgctcataattcagattaatctccattcctgtaatctcccttttttatatatttcagcagagcagagaggtccttgttcatattagcttatttgattaattatacagcttaccatgcaaaaagacaacaaaatacccggaaagtttatccgggtattaaaaagcactgatatgtatttgtgtgtccgtttatgggttgtaaggagcggaatggcgcctatatatttaagctgattgtcaatttctcagcaaataccgcttctcttcatcctgctgtatttccccagtcttctttccatatttcaaccctttttccgcggctgccaccaaagcagggctgctacgggcatatcccattatccggattgtactcttaataaggctatccttatccagagcccccttttccgtaagcgcaatgcagacagcattcttaagctcctgctggcaaatctcgtctgcagctctcttgtcgctggaattaacttcatttctgcaaatcctgtattgatccggatcctgatctttgcgccagtagaactttactccagcctgcttattcattctcactgaaaccttctttaatgctctgtctgtcgcttccagagtctgcgggctggatctggagatatgaaatgcccgcagcgttttcttcaccagccggtcatacataatcggagcttccgcatcaacaatccgctgcatcttatcaacaatcaacgtcagattttccttttttatgtaatcagctgtagacaaatccgtcacttcaacatctgcaggactgtactcttctacacggtattccgtggccgcaggatcggcttttacaattgattccacaggttcattcttgccggaagccactttagcatacgcggtttcaggaaccggattctgtgcagcaaaattctgcttaacgggcggtactggttcctggaccaaattcatctcatctacaggctttttctcagtaaattcatctgtaccactcttcaaatcccgattcacttccggcttttcttccgcggcagccacatcactgattgtttccgccaactccttagccggttcctccatcggttcctcagatggtttctcagacgcttccgcttccatttcaaatgtcttcactgaatcatttacatgctgtttataaatccggtatgccgcttccttcttttcaccaagaagctgcatcagtttcaaaagttctttatcccggttatcccaccaatccatggtccagatacggtgcagctcccatcccagtccattcaggacactgatctgagccacttcacgatccctggtgttcgttgattgacgataggcttctccatccagcataattcccagcagatactcttcagaattgtatggattaataacagctatatccaccttgaactttgaatgtcctacggctttctggtactgatacccgccatccgttattgcctggcagatatgctccattattccctgccctttctgcactctggtttctatatattccccctgcagccggcctttctgcgcaaacatcagaaaatctttaagagcctcaacgccctttgactttgttctcttaagatcgatcatatctgccgtcatagtagtgaataccagcatttcagatcttgcacgggacactgccacattcagacgtttccatccgccgtccttatttaacggaccaaagttcagtgacagcttgccttctgcatccggaccaaaagcaatggagaacagaataacatcacgctcgtctccctggacattctccagattcttgacaaacaaggtctcttctcctgcattcgcccacttatcaaaagccgcatccttctgatactcctccaacagcaaatcctcaatcaaggtctgctgactgatattaaatgtgactacaccgatagtctgtttctttcgttccggatcttcatatcttctgcggatttctgcaacaatcgcttttgcttcgccttcatttacacgcccttttcctcgatcaaagaatccttcgaccttgaccagacttacgcgcttttccctgtcatttacagacgggaatgtaagcattgaattctcataaaactcctgattgctgaaggcgatcagactctcatgccggctgcggtagtgccagtgcagatatgcagatggcatccccagtgccagacagtcatccaaaatgctgtctaaatcttcaatatccagattatcttcatctactttattgccggcaaagaaactggtaggcggcatctggttcggatctcctacgatcaccgcattctttcctctggccaaaacccccaccgccttacaggtgggaagttgggatgcctcatcaaaaatcacaatatcgaacagatcattttctgccttcagatactgtgccgctgaaatcgggctcataagcatacatgggcataatctagttaaaatatggggaatctgctcaaacagcgccctgatggacaatcccctgccgttgctgctgatagccctccttaatatgttcagttccttgctgacttccacacagtcgttcgatgtcggcagctgatgtgtcagtttataaaacatctcatctttcgtcaggtccatgaattcctgatccagctttttaaactgtgcaatcttttcattgaagccgattccggtaaacccatttaataccggctcattttcaatgactgacagaataatcgccctgtagattgaacgaaaatataccgtcataacctcatcatgcggtaaacccgcctcatacgcatcgcaaatcggtcccagacctctctgcctgcactccgccgcaaactgctgatatacaatccaatccttaatggaggatgcattttcaagaatgcaggagcagagtcccactctgctttccagatagttcccttccgaatggtcaaatgtcagatccagaagtttggatgcctcagtctcgtttttcgttacggcatccaaatctgcaatcaataccttcgctctctgaatgcaggactttaacgttccttccgcttccagcttccggatctgttctgagaactgggacatcatctgaatctgcatcttcactccatttttataagcctgcaaatcctcttctgaaacacaggattttaaaatctgcttccattcatacggcagttccgcctcagcagctgccatttcctgcgcttcctgctgatagaacgtaatgtctgtcagataaagaggaattcggtccgtctctaccgtaaaagctgcaaatgcctgcagctctgatgtcagagatgccaatgctttccccttaccaaaaaatttcttatttgcctggtcaaacttatcccgataaggattcatgtccatacgaaggaaattttcgttccactttaaacggaaatccgtctgtttggctgagaaggcctgcagtcttgccagataagtttccggagtcacaaattcccggtccacattatctgtctcgcgcaagaatgcggggatctcttctgccattattacactctgggcataattacatacttttctatactcattctcagtatcaggggccttaacctccatcagtaccacaaactcagatatatccgtctggaatttctttaacgcaccggtatacgcacgaatgattgattccagatcaaacttcaggcgctggctatactctgtcttgtgaacagccataaggggatggttatgaggatgtccgacgccctttcctgccgcgatcaattgctccaggctatacgcctgatggtccagatcacgttcggtaagcgtgcctgcataggcatgatcaaagcggacgcttcttttgagctctggaatcatctcataaatatccatcagttcacgaagactctttccaaatggtctctttacatgcagagctttcgcataggaatccagctcttcgcgcattttgcggatatcctgtatcttcttgtcatagtctgtcttcattcccccgataccgatctcaagtccccgcttcagctgatccagcaccgcctttttcgttgctttactggaatgtagttccagacagaaatcctggattcccagcgcagccagccttttctgaacgacctccaaagcagccattttctccgctacaaaaaggactgtttttcccttcgtaagcgcattggctaccattgctgtgattgtctgagattttcctgttccgggtggcccatgaagaacaaaactaacatctgccgctgccatattaatagcgcgaagctgtgaagaatccaccgttaccggcaaataagcctcatccttgtccacatgttccggaatcttacaactccaatccactgcccccatcatcaggctatggacaattttattattttcaagaaacgcgctgttattgtgtatatcattccacatgacaaactgtgagaaggaaaaatttccgataaatcctgcttctaccacatcccacatgggcaggttcatcacagcatggcggatcagtgcaaaaaccttaggcatatccagcccatgcatatccataggcggcggattcagcccatagatctgtgtatcaaacttctgcttcagaaattccaacagcgttatattgatctgcgcatcttcatcacgcatacgcatcccataacctttgctggctgatttccggacgatatcaatcggaatcagcacaatcggagaatatctggcagttgtgctcattttgctttcaaaccaccgcagcagacccaatgccagatataaagtgctggcaccattttcttccatagatgttttggcagaacggtacattttggtcagacagctgttcagctccttctccgggtagagagaatgcagtctcttatgcttactttccagtgcaataaaatccgcaaacggccccagttcatccaaagcttcgaccggaactcctccctctcccgcaaacgacatagctgccggccgcggcataacctggaattcttccccatcagacaatgcgtcctccaaaatgcttacatcagaacacaaaagcgggacaacagccttcgtcatacgcatattgatcaacatatttctcaggcttaagtccagcagcttgcgctcccactgcgtcagctttgtgacctgttccttttgttgagaatctgaaagatcaaatacttccaccttcttctccgtagcattcgttacgtctttttcttttctgtcctcatgctgtacttcaaacccgatgtccgtctttacgcgcaccggcagcggacggatccccatgcttctggcacgtttcacatcaataacaaatgcaaaactgctataattcgagacattgcgctctgccagtgttaccgcctcgtcaaaacttttaatctttcctgcgcacatggctgtacactcaacaacaaccatttcgtggatgcccttggacatacgcttttccagttgagaaggatcatccataatcatgtcagaaaaagattcctccaccagccaaacgccggcgaagatgtgtcctctcatcataaccataatggggttcaaccccattgcctccaggcatgccacatacagcagcgtcatatccatacaggtccccaaatgctgttctaacacagcatccgccaaacgaattctctgaccaaaggtttcaaagcttgaaggcggctccgcatatgtaatatttttctgctggacagccgcgtaagctgcggcagccatatgtttcacccgattcgggtcatcaaactggtatcctgccagagacggatctcctgtccatttttccagatacctggccgccagctggagcatgctggtcacgacaggatgattcggcatggcaaacgctgccaaaagctcaggtgtatactgtaggcccggccactgatcaaaggccagtgccgtaagattcgttgattctgaaaccaacaggctctctccagaatatatgcctactgtcagctgacaggtgcagcgttcagtaagagagaccagatagtccgcattgacctgcacatctaagtttctaaagtgcagttcctcgccaggctttatcttctcaattcccagtttataatcctctgtaagcccattgccggtactgatccgaatcatcaggtgctccagatcaatttcagatacatttttcacacaaatatctctgacaatatgtgcgccattatgaataatcgcaaagttaagcacgtcatcaatattactggtcagctgcagacaattttttgccgggcttacagccggctttccttcctctgctaatgccggttctccagcaaccgattctgccggtattaccggctctgataatgttaccggctctgataatgttaccggctctcctggttcggcatcaggctctgcccttgtacaattctcccacgccaacataactgcagccatatgcttacaattaccgcctgctattgcacacggacaattgcacttcatggaagatactgtgtctttgctcaaccggatatccacatcataatcttctatgtctatgaccctcgccgtgacatgattttcttctatccttaaatcctgaaccgggctgctttgaatatagtcctccgccccatttaatacattttgattaaaacgtgttctccactccacctttaagcccccaatcccagttataaactgccggcaaatctgttacttcttatgccacagcatttgcattaatctgttcaattacgctccgtattcccagccatacattcatatccgtaaatatctccaccacactgccccgatccgtaaacggcggctcctgaagcaccgacagatccttcagcataccgttatgaacaatgtattccacaatctgattgacaaaatagatctgcctgctgtccagattagcctcattcaaatatgctgagaaagcctcctttgctgcattcatgtctagtcccacaatttcacgtacaaattcgcccaacggcttttctccatactcccgttcataatcttccttagttccaagctcgccccacagaatctcctgcaatgttttcacatctgtgtcagtaagggggcggttggtcttaagcttcgcaatagcaagcgtgtcctgatgctgacggatatagtattccgccttcgccttatagtttgccagttcatcgttttccagctcagaatcattccaggtcatatctaaaatatcatcggtgaaatccgtcatgtatttccttggcccggttgtaatgatatatttcatcaaatcacgcaattcttctctgatatgttcaaactcatcaatcccggcgttctctaagtaactggtatggagaattttctgaatcaactctgattttgcctgtatctctggaatattagccacattggcaaccgcctccgccctcttaagcaggtcgccccgcgcccgcgtgtattttttgccgctcaggtaagccagttccagcccatacatcagcgcgtcaaaccgcactgcgctggcatcctctttgtccggtttaatcagcggagcgacctcctctttgaccagcatgacagactcataggtcaatcctgtataattatctgtatttgcataaaaatccacatactttaaatgctgctgcactgcaaagtttttccggtccaatgccgacactttattactcattatctccaccagattttttctgtattcgatcaaccgttttgtctggtgctcaatgccctgtagcttataggcaatctgaaattccaggttaaaaaccgctccctgaagcgccaccatattggctgtcggcttcccctggctcatacggaagaattcaaaattcccgcagaaatcaaaaatatagaacttatctttatcgcttccatccaatagtcccggacagagtctggttccccttccaatcatctgccagaatttcgccttgctcataacctttttaaaaaacacaagattcactacttccgggacgtcgattccggtatccagcatatccactgaaattgcaatctgcggaagctttttcgggtcagaaaactcatcaatcgcactttgggcgtagttgatccggttgtcaataactttcgcataatcattaggaaggtgagcatattccttgtgaaacacctcataaattttctctgcgtggtcatgattctttgcaaaaatgatagtctttccaagctgctccccataatccacacgaatcccttccgtcattaatatgtgaagaaccttctgtatggtatcctcgttaaatatccatgtatttaaagcagaggctccgattgcttccggtatttttccatcttcgttttcaaacgtatcctcatattgttctttgtcttcttctgacaactcatcatatacaatcccatggtcaatgaatttgagtgtggtttccactgattgaaaatctaccaggtacccatccttaacagcctgggcaagctcatagccatatgtcgggaccccactttccagttcaaaaatggaatatgtgtttttatcaatctcatcctttggagtagccgtaagtccaactaatggggcgtcaaaataggtaaaaatgtccctgtatttattatagatagacctgtgcgcctcatcgcagataaccaaatcaaaatggccgcaggagaacactttgccgtccgcgtcctttgcgccgtcaatcatatttatcatggtttgatacgttgaaaatacgcaatgggcgttatagttatctttatcttcacagagattggtgcaggacaaatccggcagcagattcacaaagtttctctttgcctgtgtcaccagcgaattgcgatcggcaaggaacagaatatttttaatccatcccgcatcaagcagaacatggcaaagttcaatcactgtcctggttttaccggatccggtagccatcacaagcagtgctttccgtttatttttcacagaaaagctgtcacacaccgctttaatagccgcctcctgataatatcgtccggcaatgtttttatcaattgtgatatttcggaggcccgttctcatggcgcgcagattaaaccatttttccaaatctctcttggaataaatggctgcacattttcgttccggatactgtccgtctatgattctcgtatcaaaaccattggtcaggaatatcaccggcctgcgcttatactttctttctaacagatccgcgtataatttcgcctgctgcctgccctcggaaacatccacgcaggtacgcttagcttcaatcactgccaacggtctgtgggaatcgtcataaagcacatagtctgcgaatcccactccggattgattgggcattcccaaaacctctacctcattgagccaatcctgcccttctctccatcccgcgtccatcagcatggaatcaatataaagcttgcgggtcttatattccgaaggttccagcggctttgtcacatactccggcgcctgcacttgacgtctggctgtcagttcctcctttaatgccgcattttctgccatcagagcctttaaatccacttctgatatctgttccgtctctggctttttgtcctgcttttccgtgtcaagcaaagcagcatcatattggcgctcctcatactggtccccatagcaatatgcaataaaatcaaggaaaataaataaatcctgcagacacaaagccgcctggtcaaatgtcaccttcttaccggtgtgcgccgcattatttcccattctcctgataaaatcaaggcgcttccagaggttttcatcaacaatatctttaaattcttccgtatgcatcaaactggataaattgtcctgatacggccgaaccagagattgatcaattgaatacatccactttatggcgaactccattgacctgcggcagttgataatgcacgcctccgggtcgatatgtataatgcgttccgcagatatggcgacatccgcaaatatatggaattggggttctgattttaaatagtcgaaattggtcatggattggcacctccttggtggggatttggttgtggcacttatatcaattttgatttgtgttacacctcgctttttaatcagtataacatggatactagccaaaatacttctgcattaagctatcaaagagcacttgcgtctcctccagagatttttggatggcagctttggatttatctgtttgggcaacgaaatcggcgaactgttgttggaggtccagaggaggtacaattacaggcaaagctctaagctgcgtcatattaatactagctattcctgttgtctgctttgcacaacctaaaaagtaccttttcgctttttgatgttggaggtattcttcaaaatattccggtattactacagttctgctgagtcgaacacgaaacacatggttttgatgaatacagttctttaatggattttctatgattgctcccctaccaagtttgtcgggatcaccgccctctgtcataagaacatctttagacataagcctgtactgttcgatttcctgttcggttgccataattgtttttactgtagtccaatcaatatacccctctttaacattagaaacagacatatatggaacttctatcaaaccgctatcgtgaacttttcggcctttagtgattcctgaaacaacatccgccaatgtatcaagcttaatctccaaccattccatagggtttagcaacatatccccaaacatctcaacaaatcgggctttgataaggttgtccaccatatctatctgctgccttctatatcctattattttttcaactttctctaagcggcgaactatatccttctgttgttcaatatcaactaaattaaatgaatatttttttatatccggaactgtaagctgtggaatagatgtaccgctgccactcggttttatttttttcaaagcataatacaaataatcattcgaaattattttatgattaggtattaccgtaataagtcttacaactggtagaaatggttcatatctcctggcacaatatccaatagttcctctcgcagcaaccgtaacacattcatcactaactctcgctaagtcagtatatccgtacaacccattatttttttctgcatttgcataaactggaaccgaatacttctctgtctttttaattgaaaacctatctttaggaacatcaccgcctgcaaatatttctttactcacatctacaatacttactttcatataacctccacaaatctgaattgtttccgcaccaccccgcaaaaacaacccttcttcgcttttcctttccaatcgtttccaatccatctacagcattgccttcaattcctgcaattccctggcaatctgcgcgtctaattccagtattttatccataatctccgatgttggaggatactctaccgccacatattcaacctttttatacttattaatagaaaggtcatacccgttatccacaatctcctgtttcggaacgagaaatgatttttcagtacgttccctccccgcttcctgagcgcggtttaaaaatctatggataatatcctgaatatcattgtctgaaattggcgcacgtttgtcatccagactaaatccatccgcctgcatgtcataaaaccaaacctggtctgttccgccgtgaccggtctttgtgaaaatcaatattcccgtagatacaccggcatatggtttaaatactccggatggcatggaaatgattgcctccagcctctggttttcgaccaattctttacggatagccttatgtgccgttgaagatccaaacaacaccccatccggaacgatacaggcgcatcttccgcctgttttaagcatcttgacaaacagttccacaaagagcagttctgtctttttcgttttgcacatctttaataaatctgccgatacaatgtcataatccaggcttcccttaaatggcggattggccaaaatcagggaatatttatctctgtctgtattttgatccgacaaactatcccgatattcaataaatggattattgataccatgagtcatcatattcattgcaccgattcgcagcatcgtccggtccatatcaaatccatgaaacatgtggttcatatagtggtctttttttactttgtcataaaatatttcttccttgtgatgctcttttaaatattctcctgctgccaccaggaaccccgatgtgccgcaggccggatcacatataatatcatcggcagacggctgcatcaattccaccatcatcctgataatatgacgaggtgttctgaactgtccgttcacccctgagttcgccaacttggaaagcagatactcatacacatcgcctctcacatccgtatcttttagtcctgacatctgatgatacagttcatccatagcgtctactattttggataacataagcggagtaggcaccttgaaaatagcatctcccatatattttgaataggcgctgtccttctccccatgaagattcttaataaacggaaatatcatttcctgcataacagaatacatcttctgagcgggaaaatcatggaaaaccgaccattttaactgtgtgccgtcaatcattctgtcacccaactgtacctgggtggaaaaaacacttttgtatggaagtcccagcattgcgctctcttttgcgtggatattatctgtctcatccagatcgtgaataaacatcatataggtcatctgttcaatcacttccaatggattagtcaatcctcccgtccagaatatctcccacagactgtcgattttatttttcagttctcctgtaatcatctctcattctcccaattccatgtgtattttgtataacgtccgtttccgatttttatgattctgttctgctttgtaagctctgtcaaagttcgttgtatggttgtctgactaactcccggaactttctgcaggatttccgattttgtaatggttccaatctgttctttaatcgcctctgccacacgatccggttttgctgctgttctttcctcaatcagccgggttcttacaataaaatctctgtaagccgctgctatcactcccagcagatacgtcacaaatggagcataatcattctcctcctcatgccacaatcttgaactgtcctggagagcatcataataagaatcttttgttctctcgatcaatttttcaaggctgatatacttgcccactatatattccgacttatacagcagcagcaaagtcagcaaccggctcattcttccgttcccatcccgaaacggatgaatacacaaaaaatccaatacaaacatcggaataatcagcaatggatctgcatccgttctggttatgacatataggtatgcttcacaaagcttgtctactgactccgatgtctcccaagctgccactggttgaaaacgaactgatatcttaccatcaacatttttctcttcaatcatgttatcagcacttttaaatactccccccatacccccattctcaaatttatataaatctctgtgaagctgtaatatgaatgtggatctgacgggtatatgctcatgattctcatgaattgtactcaaaacatccctatagccggcgatctcccgctcatccctgctccttggcattgtcttatccaatacaatttttctcagtctttcatcggaggtatagattccttcaattttattggaactttctgtgctttgaattttagctacttcgactaagccattcagtacatctgcatgtctgctggcaatcaatcgctgctcacctttgtattcgtgaatcgttgtaaggtaaccgacaatttgcggcgtcaataactttttccacttttcagtataatcataattcctcatccaattacctcatccattatacaactacctcattataaataatttgagctaattaaactataacattcatcttcatcaacgtcaagttcaacttagtcatttaaagcattttgactaagatggattttattaaaaattaaaagcagggttcgaggaattcttctcctcaagccccgctcacagtctaaatactccggcttccccgctttattcgtgttgtctggagctgcatcttctttatctgctatcagcagttctctccaatattacgatttgttttatctgctatgtacagaataaataacatcactaataaaataaatggaaatataaggccaacccccataccaacccgaatattatctccagctttctgtgtgacccggcccacaatacccggtcccatacttccgcctaaatctcctgccatggcaagcaatgcaaacattgcggttcctcccatgggaaactttttagatgaaatactaattgtcccgggccacataatcccaacagaaaagccacacacaatgcagcccataagtccgatgaatggattagatgatagcgaagtaaggagatagcataccatacataagactcctgatcctgtcataaacttcattaaatccattctgtcaccatattttccaaatatgacacggcttattcccattgtaactgcaaacatacaggggcctgctaagtctcctattgattttgacaatcccaatgctgcttctgcgtaagctgatgcccattgagccatggcaagttctgatgcaccggagctaatcatcagacaaattgccagccaaaacaacggggtcttgaacaattctcttattcccattcctcctccctcatccactaaatgttcaattggacatgttgcaaaattgtaaatatttattgccggaataaatgcccaaaatatggccagccacttccagctgttcatcccaaataaatagaaaaataatgtggaaatcaatatcgttcccactgcgccccagcagtaaaaggaatgaagcagactcattgtcgcttccttgttctcaaatgggcatgcctctacaataggactgcagaggacttcaattaatccgcttcctatcgcataaatgattacactgcatattattcccataaatggatttggtaatatatccggaagaaatgccagaccaaaaagtccaatggcagcacacacttccgaggatacaatacatgtacggtagccgattctatccacatattttgcacaaaacaaatccaccaaaagctgtgtaaagaaaaagcaggtagatatcagtgcaatattaccaagagaaatatggtattcgttatggaactttaaaaatagtagtggcgcaaagttagctgatattgcctgtgtaataaatcctaagtaacaggcggttttcgttctctgatagtttggcataatgttatcagtatcctttcttttctcttgttatttgcagcaaatctttattgcgttttcatcgccatacagaaagcatccttcatagtattcagaggtgtaccgcggttcgtaatttacaatgaatcccgcttctatcagtgttatcaccaattcatttacatccggtttatcatcaacataaatagaaagacattttccggatttatacgtttctatttttattactgcattcatacgcagacggaccttccatttttactttcctgtttgtctccttcaccagaagttaaccatttaaatcccatgtgctttcacctcgttttttattgaattatataatataaaaatcaggttttcattgatttatttctcatatttattgtacaatatcgtaatagctcatttgaggagatgattcttatgaattctaatatatcctataataaaataataacagatgaaaatttaatggaaacgattcaacatggcagtaataactatccatttaatttttattatgacaatctatcccaattcgattttaactgtatagaatggcactggcataccgaattagagtttgtgtatattgaatcaggaactgtgaccttctggattggggaaaaacaattcgatttatctgaaagaaatggtgtattcattaactccaaaaccctgcaccgcttttattctgctgctgaagctgttatcccgaattttgtatgtatgccttcttttattgctgcgccggatagtctcatatatcaaaaatatatcctgcctgtactatcttctttcctgatttttcatgaagaagttccctggcaggcagaagcattgtcaattataaaacagataatagctgttcaggactgtgtttcatcctgtgaactgtctacatcctctctcattcaaaggctttggctggtaatatatgaaaacgcagatattacagaagtaaaagaccaaatgattgattccgcttcctcacaggcaagattacagttaatgatgcagtatattcatcagaattattctcataatatttccttagaagaacttgctgctcatgcaaggattagcaaaagcaccgctttaaacctttttcgcaaatttttacacattacgccaattaattacctgatacattatcgcttaaatgaagccgctctattgctttcaaagacagagaaaaaaatcaatgccatttcttatgaaacgggatttaataatgtggattatttttgcagattatttaaaaaacattatgatttaacaccaactgaataccgtaaaaagaaatctgcaaatttataactccagttgacgtctaccgcataaacataggcagaccgcaccatggcaatctgcctatattatatattttacagatgtctctcccggtttcgcctggctttctaagacagacgaaagaaactggacatttctggtaagttatgagcctttcactttttcttttcattccggtctcctgaaattacgtaaaatgatatagtatgctcagacggcaaaaaacatccaatacctcctttgagatattggactttttgcttattattagactttttcaaatcatatcataaaacatgttttaaattatagtctattcataattatatactatttataaatcttttaatattatatattgattaaatttcacagcgctggaccgtcaatcttctgttagttccattttccgcctttccacctgatagccactgtacattgcggtttttattctcatttttgcatcattccacaaacaacatcactagtccccggattaatgccagaaatcctgctgtgatttgttttgtggcggacagaacatgtaaaagttccgctttgctatccgtccgcctctctcaagctgctcattgtaataccgaatcaaaaaatcggtataaatcctcccgcctgcgcaattgccatccaaccagcataaaacatgtcctttatatacaattactgaagccgtaatttaatctggaaatgaggatctctttcaggaacactcctaatcatttcagtaatattttgcactgcttatccatttatttttcattgtcctcctctctttttctgccaaggaagccatacaggccaagcataagccctgacatcagacatacccactgtgccattggattctgccctgtcttgggaagaggcgccagtggaacttctcccggttcaatggtaactccttcgggaagaggcgctaagggaactgcttccgattcaatggtaacaccaggtccgttggtatccggtgtcgcgcgatgcccgcccggggtggtacctccgccgccactggtacctccgccggatgggggagttggcggggttggaggggttgggggagtcggaggggtggtgttttctggtactaaagtaattgcagcatagtatccacaattgtaatcctgatatgcatttcccattctgggatggaaaaacattcccagagtaaagtcacagctttccccactggataatccgtcgcccagtgtatctgcaaaacttgcatccgcgctctgccattcgctggtatcatgatccataaacagtgcaaggggtgtatcatatcctgttctctcaccaaatgtcacaccaaataattccttataaaaagtgtcatataaaagacttccaagctccggttccacctcataaagccgcgctataagtttactttttgatgtgaaaatattagcgaagtcaaagtagggataagtaccgtcatacttggctgccacttcgtcaattgtaccgcttaaatcaaatgtgccgttattacccacactttccattgataaattgccaaatacagtacttaaatcatctgtgtgatagtaattcttataataatccgttaaagggtaatcgccatcatatcctttttcatataagacatcataaatagtcagcatgtcttcaaaatttatttttgttttgccaaacagatcctttatagcgttgttttgaacccggtacgctccataagtacggtcaattatctgtccgtcaaatcctttgatcgtcacatccattcctgaaaaagatgtatcaacatttgattcgggagtttgaaccgataggctgtttgcctcatataaatactttatttgggaattgtttttcaggtttaaatttaaattaaatttattcgttggcataactccttcgtccgccccaaatttgcgcattgcttccataaaagcgtcactcaacacaaatgtaagggggccctctgcatcttctgcgattgcagcatctacggtaagatcatacccaccctgcacttgattcaaagtgctatttgttgtatcaattactatatattctgaattatttctatactcaaatgtacttgatgatgataaatatgatgtaggcacatatctatgtccgaattcgttgccatccggatatgctattgcaaatactgaaaaatggctggtttcaaatgcaaccgtcccctctccttcatttacatcacattttagatcattaacttttagatcattttcctgatcctcaaggtgatacacgctaattttatctgattctacagatcgctcatttgaaactgattctggaatatccaggccggaaaatgaaacctttacattacatcccggttgaaccggctgtccgttttcatcctccagggttatgtcaaataccctaacctcaaccgagccgtaaccatccgctgcacattttcctttaataacagaactggtatcttcatcatcaattgcaattgcagataacgattttaccgaagcgtcaaattcaccatccaacggctccactgaaattgtaattccgtcaatctctgccataaatgctgctgtatcagaagccgtttcttctgtttcgagaagttcaacctcaatatccagattctcctcaatatccgtcactacatacgttgccataccggccagcccgctgtctccctccgtatcctcttccgcttcagcagccagctcgtatccattggctgttacaatctgaatcacataaccatccacaggtttaaccgtgaaagataactcctcgccctcctgtattaaggaatcaccctcaacctcagctgcaccctccggatttaccgtataggtgattgtaaattccttctctttttcctctttgtctgccaggtctccagctgccgccccgccacctgctacaccacctgctacgccacctgtttctccattgacgtcttcttctccttcgattccagaatcttctgcgccttcccctttgtttccggttccttctccgctctcgcctccggcggtttctccgccttctccttcacttccggttccttctccgctctcgcctccggcgttttctccgccttccccttcacttccggttccttctccgctctcgcctccggcggtttctccgccttctccctcacttccggttccttctccgctctcgcctccggtgttttctccgccttccccttcgcttccggttccttctccgctctcgcctccggcggtttctccgccttccccttcacttccggttccttctccgctctcgcctccggcggtttctccgccttctccttcgcttccggttccttctccgctctcgttaccacttgagctatcgcttccaccagtgctgtcgcttccactggaactgttgcttccgccggagctgtcgcttccgctggaactattgcttccgccggaactactgcttccacctgtgctattgcttccgccggaactgttgctttcaccagaacttccgcttcctcccgtgctgtcgcttccgtcatcactggtaatctcctgagccagggacacattcaaacatgttccgacattagaaaaagcaagcacgatggctgtcagcagcgctgcatggcgtgaatgctttttcataacatttttctttatcataaccagtacctcctgatatttacaaatacaaccttttactcaactcatggtaatataatataggagggggcatttcaaaaagcatttcaaagaaacacaatttcatgtctattttcagctttttccaatatgtgactgaaatgtaaccaaaagggaatctttttcaagattcccttgctatttctatacgcacagagtgaccgccggagcgaaaatctgcctgtccattttacacagacacgcgcggtcatggccttctccttacagttttttcacgccttttttcttcttttcctttttctgcccccggacaccaatccttcagattcacgttttctatatgcagactcaccttttgtccataccttctgcgcattccggatacaatacggttttcaacaaggtggcatttgtcttcccgcagttcgtttgccagaatcagaatctggtccggtccgtacttcgtataaacgtctcctcttcgaagggtactgtggaccacttcacacagagcgtcctcatactcctgaagcttcctgccatcctctaccggacaatctttcccgtcccggaccgtgcatacaatcagaaatcccctgcgtttcccccgctccacggaccggataaccatacggaagcagtcaacaaatcccggataagtacaataatacgatccggccgaccagtccctttcctcaagattccccctgatctctttcagaccgccattcacatgctctatctggctgccaatctgtttgaaatatgccagcacgtgatccgggggaatgctgccggtctcgtcaagcagattttgtgttacataatcatatgtctttaacgcgtctccataccgctttaacgccaacaaagctccaatcttttgctccgcccactctgccaggggataggccgcagttgcggcatcgcacagcctcacaatcttctgatggtcccgatggagcttcatcaggcggcaggcttccctcacgcctttgaaataaatatcctggtaatggctccaaagagattccgcccatacctcgccggacagaacaggaaggaattctccgccgtaaagacggcaggcctgttccagaagcagctggcgtgcagcttcatcttctgtttccatggcccggttataataatcttccatgagagcggcgtccatctgaagttcaagttctccccccactctccccattttcaaataatatgtatttttttcgaccaccacatattctcccaaaggcagaacggactgggaaagtatttttctcagacgtgttgttgtaattctaagcgcatttgcagcatccgtacttcttctgtcataaagaaaatcctgaagctttacgcggctgattccattttctccagcccatatcaggagcaggaaaagctgcatcacctttcccttaaccgacatcggcagctcccacggctctccattataaagtatctccagtgttcccagcgtccgggcatataatgtattcctgaccgtcaggttatttttgtttatctcattcatctatggtaccgccttttagcgtctatttttccaattataaccattatacaggaaaaccatttcaaaaagcatttcaaacttacattattctgaaattatttatatttaaggtccatttcccggggtaggaatggccaatttccaatttaatccctatacgcttccaggcccataaacttcaggaatacaaattggtggagccggacatttaagtgaaagaagagttcgtattgcgcaaaaaaacgggaaagaatctacaataagataatttcccatttttatgttatctattttgatatccgcctaattctccgcctttctgacattcagaaagtcatttcattgccgcctgtcgtttccccagtatttctgctgccttcagtgcagcctccatcatactgccaaaagcagaccggcgctcctctgcactggtcttttccctggtcacaaaggaatccgatatagtcaaaaggcaggcagctctttttcccaaaacctgtgcattatggaacaaggcaaagctctccatctccacacattcgcatccgtgcttttcataaaaatcacgaaaactttccatctccggttgacggtaaaacacatcactggaatggattttagccggtttaatctggatattggcaaggttgcctgcgtccaggattatctggttgagctgctggtctggatatttggtatccgatgcatccccattctgagtggctgcatagctggattcgctccagcagccctctgccagcacgacatcgtacagtttcagcctgtcgcagtaggatcccgctgttccaatgcggataatatcatccacattatattgtgcaaacagctcataggaataaatccctatgctgggcatccccatgccactggccattactgtgacttctgtgtcatggtatctcccggtgaatgcatatatattacgtatctggtttacaagctttacatccgtcagccagttctttgcaataaattccgcccgaaatggatcccctggcatcaaaacagtccttgctatctctcctggctcagcgctgttatgtggtgttcccatattagcctcctcttatatttcaactatttttcatatgtatacacttttgccctttgcccgtccccatacacaatcatcctgccgtccagtcatatccgccgtcctgcttctggttgagtctgggatcacccggtgcgcccaaccctggctgctcctttctgtcttcaatgacaggattggattttaataatatcccccatcttttctctgccactctaaatcaaacttaggcctgctgtcgtagcgcctgaccttcccccagaaatgttcttttccgtctatgaaattctgatatccaatcctctccagtgactcccgcgccactttatccccttccatcagaaccttttcctcatcgacggaaagaacttttccattttcaagaaggtgcacaccgtctacaaacacattatccacgtcatttccatttcccaacatgaccatcgtatcaatgatgttaaaccgtggcgtcatccgcgggttcatcagattgacggtgataatatcggccttttttcctatctcaagggaacctatatcatcctcccacccgattacctctgcggcatcaatggtggtcatctcaagcagcctgtcactcggaagattgaacatgaagttggtgctgaatgtcagctcgtccttatgcttgttctgagtcatgcgcatggactgaaacatatccgcgtttcctaaaagcttgggcccgtctgttccgatagcagtctttacccccatccacagcatgggaatcagcattgtacttgactgaaaggttactcccacatgggtccctgtgtctgccaatatctgaagctcatcaaaggagcagccagaggtgtgctgtaaatgtacccttggccccagcagcgcaagcttaccagccttatgcatctggtagatggaacctccgtaagcctccgcatggatcctggtatcatatttatctgcaatgcgccacatttctttcagctggtgcaggtcgaattccgttggtcctgcccacatcacatctgcctcagtggggaaggatgagttggtagagggaagcaggccgaagggcgatacaaaggcccggattctgtcattacagctatggttcagttcgcgtatgacagtctccatactttcaattacctgttcgtagctgacttccataagcacacgctttccgtctatgatccggctgaatttatggggccacggcggctggcttggtcccgtgcagaccacttcccttaaccctgtctcggaatatcctttggcgtggttaatggaaaatacagggtcatcacagcgctgctgggcgccaataatgcacaccgaggtggttatgcccgccctcagatggtccagggcgctgaccctgccctcataataccaataatcatctgtgacataatggttgtacagttgggttacagccgccatccagttgcttgtatcaaaaatcgcccctcttatgagggcatggcccccatgtccatggacatccacaaagcccggcataactgcgtggttcctgcaatttatggttttcctcacttcgggaaatttcacctctgcctctttactggagccaacgaaaagaatctttccctgatccacggccacagcgccgtcttcaatgatacgccgtttctggtccattgtcacaaccgttccctctgtgagcaataaatctatcatatacttgtatcctccttctctctttttttattccagccctgactacattccagccctaatccttttactgtcctgactattctccagtccgcctaccctttgactgctcccgaagtcattccctgcacaatatgtttctgtgcaaacagcagaaacaagatggaaggaatgattcccagggtggaagctgccatcatctgtccccatgaattcaggtttttggacacgtatttctgaagccccacagtcagggtgatcttatcctgtgatgtgacaaatatattggaaaatgtatattcattccaaacattaaggaatgtaaaaatagccactgtagcaattcccgtcattgccacaggtaataccagccttaaaaggcactgggccgggctgcacccatctatgagaccggactcctccagttcataaggaatcgtgtcaaagaatcccttcagcatccagattgaaaacggaaggttcagggaagtatagctcagaatcaatgaccaatgagtatctatcacatttatttttttgtaaatcataaaaagcggcatcagcataagcataagcggaaacatctgcaaaaccagcagcccaatctggaagccgcccagcatgcgggatttataccgcgataaggcatacccggccaggacagccagaataatgcacagacttgtaacaatcagtcctattttcaggctgtttaaggctgaaagcaggaaatcagactgcagaacggccctgaacgcagtcagctccggacgcgccggaaacagaccggtatccgacagtgccctggtatcccccttaaatgcagttccaaccatggctgctgtgggcagtgtgaaaatacaggcaaacagtatcagcactgcatatgtcagaaaatctttgatttttcttttttttccgccaaccattcccgttaccccctccctttttccctgaactggactctaaaatataccagacttataagcaaaagcacaagaatcataaccaccgcaatggcggacgcataggatatattctggcgtaaaaatgcggtgtaataggacaggattggaagcgtatatgtgtatccgtttggtcctccccctgtcagcagccagatattttcaaatgtgttaaaggtccacagaaaggtcagaatcgtactgataaagctaatgggcttaattaaaggcagcgtaataccggtcagcgtgtgccggaacccggccccatccatctcagccgcctcatacagctccgccggcacgctctgcagtccagccagcagggtaatcatcataaatggcatctgcttccaaacggagaccagtataacagtaaaccgcaccagggaatagtctccaaggaacagcaccggtttctcaatcagccccagcttctttaatgttatgttgatgatacccacctggtcattgagcacccaggtccagttgatgaccgccaccacggcaggaattacccagggaagaagaaaaatagtcctgaaaagtgccccgaaccgtatcttacggttcagcagcagggccagagtaaggccaacaacataggaaacagccacaacagaaaaggtatatacaaaggtaaaacccaggcttccaagaaattcctggtcctgtgccagttttatgaaattgtccagaaagataaaatcattccggcctggcctgagcagatttttatttgtcatactcatatatatcccgtataaaacgggatatacactaatcagcaggaggaccagggccgccggaatcagcatcaggtatgggcggctttcctttctccattttactgctgttttagagctggagcgtttcatggatactcctccattctaataggattaatttagttcctctaacacgcggttcatctcatcattggtttttttcagttctcctgccatatcgtcagaccccatcagcatggcttcaatcggcttgcccagcatgttctggacaaaaatctggttggtagcaagaggacagttgtctgccggccagtttagatctacataataatccctgtattttgcatattgccccatcatccagtctgtcttataaaattcattttcataaaaactcttgcgggcaggcagggctgaagcaccgccgtcaatataaagctgctcattgttcttcaggaaccattctatgaattcctttgtctcctcaggatgctctgtctgtgcaaatcccatgattccatctgaccatgccacttcccttggcttatccgcgctgggacctgtgaccggacccataattttggtgttcttatacatctcctcgttggactttacatgtgtaaacggacttatccacaccatggccagttttcctgaagcataaagcttttctgtgtccgctttgttgtaagaaaccataccatccggaaaatattccttgtcccgcatctccttaaggagccccatgcattccattacctcaggcgtttcaagcgctccctcctttccatcggcggaaatccaactggctccgttagtaaacattacattgagcatggcattggtgcttccctggtccagtgtaaagaatgagatcgggaacatcccttcgtcaccatatttctcctttacagcagcacaaatttccaacagcttatcccagcttacttccttgtcaagattggtaaatcccagttcatcctccaggatatccgcgcggtaatatatgtttttggggtctgtctgaaagggaagggcaatttgttttccttcgtatattcctgcttccagcattccatccagaaaatcatccgcaatcggatctttttcagcctcccacttctcaaccagctccgttaggtccagcgcctcacccattgccgcgtaattcataaggccatagtaggcagctgtggtaacatccggtggtgaaccggctgcaatagcggtctgtatctgctcaatgaagccgctccagctcataatctgaagttttaccgttgcaccgtgatcctccgcgttatactggtccacaatccgctgcagcgtcggatcatatgtgtcgcttggtccatatggcagagcccagtattctatttccaccttttctttagctgaaccggcgttttctccggtcccctccgtgggggccgccttttgtccgcatccagcggacagagccataactgctgccgtgaggattgctgttgctgctattctttttttcattttcgtaccgccctccttaaatatcacaggagactttcatttgtccctctgatttacagttgacattattataaacccatttttctttatacaaaactcacagattgtaacagttttttttcatctccatcctaattttcaaattatccataaaatcaactatctttccaaaatttcaacactccagcatgagctcctgtcacagcatgtctgtccaactcacaaaaaaaggacaacaatgcacattgcagtgtgtcctttttcataattttatcttattctggcaattctcttctgttctgagtgcggaaatctctgagggagcatcctgcatatttcgtgaaacacactgaaaaatatttataattaccgaaacccactgcctcggcaatgtccatggtacgcatttcagtggtctttatcaattccatggcgcagtcgatgcggtaatgattcagccagtcactgaacttacatcccatctcctcccgaaaaatacgccccagataatttggggatataaacatcttttttgccaaagtctgcaatgtgatttcctcacgataatggactttcagatatgcaatggtcttggcaatcaattgggagtggaccccccaccggttctcacctttgcgggaggcccccaggtagtccctgacccatttctccaggtcctcagcatacaggaaatcatccagctgatattcttcaaaatctcccagcccctctccctggtcagatgctgtcatccctcggtaaaatgcaatcagctggctcagacagcgccgcaattcaccaatatctgtctgctcccttctgcagataccgaacaggcgggatacatctccggtgcagtcacgtcccgtggcaagcgctgaaagagcatgcttcagcgtaagctgcgcctccgcggaaagcttcccgccagcaccttcatccgagtaaaatatctgttttttccgattccaggccgaagcccggaacgcctccttggcggtcctgtaagattctccaatggccataagcccggtccccgcggtgcctatgccgattacaacatgccggccgtcattatggccaatttccactaccaggcgctccgccatatcagaagttctctgttctgccttatccgggctgtcggcatttattaatataaagtattcttccggtgcgagttcacagaaaaactccctgtctcccccgcatatagactcaatcttttgtattagctgccaatagatcatgtcctgctcaacctgtgagccgcactcgtccccattctgcttgctcacatgcagggtcatcgtctggaagacaggaccgtctaaaggcacgcccagcattttagactgatggaccagccttttgttctgttccatattgcctttgagaaggtcactaataagcatcatctgcagtatgggtatactttcatccagcaaagcatcccgggtcagcttctgggctttcctgttctgctcctccacgatctcctccttgcacttaagcacactggagataattttatcagcgctggcaggcttaagcagataatcatgcacaccattttgcaaggctgcatgaagataatccgtcctgtcataccctgtaagcaggataatacgcaggccgggcagcgcatctctaagcaggctgcacagctccagtccgtccttttcaggcattcggatatcgctgattagtatatccggtcttacctctagagcccgtctgaaggcttcctctccatcagacgcctccgcttccagcgatattccccaggcattccagtcaatataatgctttagccctcttctaatactggattcgtcatccacaatcatcagcttaatcatatatccctccctgtatcagagcatgtctgaaccgcaggcttaaatggctgtgtcactgttatcaccgctccttttccctctctgttgtaaaaagacaggccatagccatctccgcaggcaagtttgatacggtcattcatattcttgatacccagccccctgttattggtttccacatgttccagcagttggttcatgtcatccacatcaatccctgctccgttatcttttacctcatacttgagtgtctccccgtctcggaatatatttacttccactttcccatcctttatcccgctgattccatgaaggatggcattctccacaagaggctgaagcaccagcttcacaacccggcagcccagtgtttcctcctcataatccagttcaaaatcaaaggatgttttcccttgtctctttaaaataatataataacgcaaatgctcaatttcatttcccacagtcgtaaaatcatcatccattatcaacgcatgcctgaaaaattgagataaggaatcaatcatctcgctggtctgggacgcccgctccatcttagctgtccagtaagcaatgtccagagtattatacagaaagtgaggattaatctgggcctgaagcgcctttaattcagcttcctttttgcggatggttccctcatatactttctggattaaatcctgtatctggtcggccatctggttaaaatgccgggccacaagtgctgcctcatcatttccccgcacttcaatacgggttgaaaaatcctggtgcccaaaggtatccatatgccgtattacctcggacagaggttttaaaatccgctgcgacaccagaagggccagcgcggcgcacaccaggaagcaggacacggacaagcccagaatcagcaggagggaagctgatatcatgctgtccacgtcgcctgttccggataccccgcacagtatccaccggcctgctgccagaccatagggtgatagataatattcatcctcttttgcctgctcctccgtccggtaacatccaccagttccggccagaaggttattgtaattcaaaatatcccctttttcctccggaaagccggtattaaacaataaccttccctcttcatccagaatcacataattcatggatggctccatttcacttctcagataatccgaaagtcccctgctgtccaaatatagctttgctgttccgagatggtgtgaaggattttcagtgtcacgcagcaggcggcacaggtatagataccgctctccataaatgtcctcatcctgcccccagaaggatttaccattcagggcatctgcacgctcccggtcagcccgggtaatattaagcggcatagaaccattggccagcacttccccattcgcgccctctatctgaatggctttgatgtaatcactattattcctaagataaatcagggtattatatacatcatctaataactccttatcccctgtggaaagataggtcctgatatccttatccccaatcataaacaaagatgcccgctctaattcacgcatgattgtctccacagcctgtcctacctttttcatggaggcctgctggtaattttcatgattcttctcagctgtcgtaaccgtacgccccataacgaacaagctcagaaccataagcggaataagaataattgtagctgaaagcaaaaagatctttgcccttatccctctcttaattgccatctcttcctccctcttcatttctccatatgtacaggtttcggtttgatgttcagcgtatgcctcagctcctctgcacgttctttacagccataacattattcagtcagcatctacccacaaatcctaagccagccagtattcaccctgccagcttgcatatcccggagtccgcttaaacaattcctctgttttttgagggtcagaaaccaatccgctttccgcatcctgaataaaaccacccctcaatttttctgccgctttcccgtctgatatacactccaggcagatacaatgaacatcatctatacaatacatagtactgcagtattcattcacttcttttccacaacactgacagacaccgttttcatgttcaataatatcgttatcatatacgttggggtgatacttaaacacaatcttcttttccatatcattacttcctcgtaacatataaataaacgctgctataactttcaattcaggtaaattataccacatagcagtccaaaagaacataacggaatccattgtcggataacggattaagcatgcacgaaaaagaggggcttcccatgcgccgcccaatgctgtgcatgctgaataaatatgcggcccgccggaaataagcggaccgcatatctatatataactctgttcagacacatccgcatccatgggattgttgtggacatggccgaatatattggcattctggcttttctatcactgcttatggcaggttcaggctttttccaatgggcggtccaggatatcacacagatcgtcataatccatctcgccgttaaacctcagtacttcctttccattcctgaatatgactacgaccgggatacctcccacattgtaggtgtccaccagatcctggttggcatccacatccacataacgaatttcgtatgccccgtcatattcttccttcagggcttcttccagcacagggtgcagggccttgcagtgaacgcagcgttctgcgccgaacagtaccaggaccggtttatcctccactgccagtacctcatccttccagttggccgcgccgacgggatggaatacctgcgtatccacttcaaagaccttttccctctgtgacaggtcttcctcatcatccgttgccacacagagcgccacatcctgataatacggcaaagtcccctcaacatcaatcaccttttttgctccaaacgcccctgcacccggaacacggtaggtcacattatcaatgcgctcaatgggtacctctgccggaaccggctcctgcggcacataactgtaggggtaacggtaggccctgtaaatcatattgttcctgggccccttttcattgtgcgtgtaatacggtgaaatccactcccaaacaatctcatggtccggtgttacctcgatgagcctgccgtctgagccttcggttaccagggtattgccgttgggaaggcgctgtgcgctgctgacataggggctgtagaatttgctggcatccgtgggaatcgcatggcccagttccttgggagtcagtttccataccacttccagtgtaacaggattgaactccagcacacggctgtaatccctcaatgcatgtttgatgccgattggagaggatgggtttggtgtcccgtagccgccccagccgccattatcaaagaccatcaggttgccttcgcccggcagacccttgggaatcatgtggaaatgatgctgtccgataatccatcccagcttcttaagctccggcgctgcattaaaatcaggtccgagccgccatacaatctttccggtttccttatccaggattgccaggatattggcttcccggcagtcaaagattatgttgtccggcttaaaacgcatatctccctggtcataccatttattgggtcccagatagctcatgcagttcacatgcaggtaatcgcccacacctccgtctgatgcgcgcaggttggggtcgcggaacagcacgttcttggcggcctcgtcaaatcccagttcgtcaaaatgctcgctgatggaccatttccataggatatttccatcccagtccacttcaatcatggcgtcatccagcagttttttatcggaaatcttgggattgtggatggtctggtggaccaggatcagggtgttgcctgaaagtggctttgcatccattccgggtacgtaataaccaaccggattgccctccctctggtaatcatgatgctggcgcgccatccatctgtggtccctgccagggtcgtcgatattttcaaaatggtcaaattcccatacaatattgccgtcataatcaatctcaatcaggttgaccccgtcctgcatgccatagtcaggatggcggtatccggaaagacccatcacatatccgccgggaagaagctttggcggcatggcgtgcatattccagcgccttacctcgttgccgttcatgtcaaacaataacacaccatcattgattaacggaacaatcgtataaccgctccagcatttttcagggttgtaaacagtgactccgtgtggaaaaacaagtggctgtcccatatttcatatcctccatcatattattattatttgttaaaaagcctgtttgatttcaatcagctttccgttatcgtaaaatgcccctgcaaccgtccggtccagcttcaggctgttgtagagcaggttctgccttgtgacgtcctgcctgtataccttccactgtccgcttaactcctgttccagctgggcggtcttctcaatctcctcattgctgtacgggttgtagaataaaaatacggtcctgcccgaatccggccccaggattccctgtatctgttccagttccttaacatagcgctccgatgcaactgccgccaccgcgccgtctgccgccgaggtaactacctgacgcaggaatgtctgggtacaatcgcccgccgcataaagtcccggcacattagtctccattttctcattgaccttaatataaccggccttgtcgcagtccaccatgtccttcaccagtccggtctggggcaccatgcccacaaacaggaacaaaccgtccgccttcacctctgtttcccggcctgtgtcaacattctttaataccagtgactccacatggtcgcttccctttatttcctgtaccgtggaactccacacaaaatcaatcttcgggttcttatacgcatgctcggccgcaacctcgttacagtccagatgtccttcttcatgaagcactactatggtcaccttggatgcaaagccggtcagataatccgattcctcaatggcctggtcaccggctcccagcacatagatttcctttcccttgaagaattccgcatcgcaggtcgcacagtaagcaaccccatgcccggtaaattccttctcacccttgatattgagttccctgggcctggtgcccagatccaggatgacgctgcgtgccatgaaattcccccgccgttttgtctccacaatgaatgtatcgtcctctttccggacccctgtcacggtggtgcgcttaagttctaccgtgggatggccggccgcgtgttccctgaacagttccatcaggtgctgcccgctgtccgctttcgtccccggataattcctgatttcatacgtatcattaatccttccgccgtagcttcccttttccagcagcagtgtcctgcgctcggaacgtccggcataaatggctgctgacagccctgccggtccgccgccaacaataataagatcatatactgagtccataaccaactctcctttctatcacaaaacacgattttggttcacatcattttctggttcatatcattctctgcttcagctcccctttaccgtggaaatctcctgtgccttttgatgtccgccctttccagccctttctcccaaagccacccagatcacacagattcccgtaaggaacaggcagtaaaatgccgcactgaaaatctggaatggggacaccgttggaagataactatgcttttgcaccatctcattgataattgtcacactgcccatgacaaatgcactgttaataggaataatggcgctgaagttggtggcattggctgtcaggagaatgctcctgcgttccggggatatgccgctttcctgcccaatcctgtccgccataccgccgaacatcaggatggacggcagcacacagcccgccagaagtatattggtaatgacgattccggctgtcagtacggcctcagcgccgcgggtggttcccatgatattcctgtgcaaaagccaggtacagcaccgctccatcatacctccatccacagccaccgcaatcagcccatacagcaggatggtggaaaccaccacatccagcattccgctgattccctcaaagataactcccttgagccccaaagtgccatagtcaatggccacaatatcggaaggagcaagaacccctgtcagaagtcccaccgcgaatcctgacacaatcgcaaaagacaatcccatgaacaggtttccggtcctgaaacagacaagcagcagcactgccagcggaaccagcatccaaagtccctggggtgaggacatggctgatatctgggaaatatcccccatggtgcctccgcgtccgccaaaaatcagataaaccaccatggataacccgcctgccgccaggatgtagggcgtcctcatcctcagggtctccagcaggtctgcgggctgtcccgtcacgccgtcatgctgtatcatcacggttgtattgatgacctgtgagcttggtgaaactgcatccccaaagaaaataccactaatcaaagcccctgccagcatggccggattggctcccagcagtattcccggcggatagaaaatcggtatcactgcaaacatggctgcaatcggtgcacctgcccccatggaaaccatggctgaggccaggaaactaaataccacgaatccgcttctggaaatcccaagcttgaggctgagccagataaacccgtccccaatccctcctgtattcatcagcttggaaaaaatgccgatgaccataaaaacaaatatcagcctggaattgccatattgggccagaccatggaccacgctgtcccaatatctgtccttctccctgcaaaggaaaaagcctgcaaagagggagaccgccgctgcaaaggacaggcccttcatggaataatagtgaagtccaactgaaaatgtcccgccgatcagtatatatcccactaacggcagcatggcaaacgcctggttaccataaaatgtaagtttcgtttcctcagtcttcatattcgttccaccaatccctcctttaagatagttaaaattataacaggtttttttcgggggatgtgttggagctccaacacttatgaaaattttataatttattatcgtttttttaacataacagagtcattagtacgtatatcattgggcagcggttcgtcaatctcatgtcaatgctgtcattatatgttcttttattcgtttttaattgtgcataattaatcactgttttttacaaaaaaagagcccccacatccagacggatgcttggaagccctttctatatcagatttgctcatctttttatcagttgtttgtctatttttcaacattccagacaaaaggggaaaataggaagcggagccgccggacggcaaacagcacacgaagtgcgcacacagaatagtgatatttactactccttcgttggacagataaattggcccaaatggattgacccaaatggattggccctatgaccgccctatgggtccttgaaatacctccgtttcaaataccgatttgtccaactccccacgcaaaccggacattcattttgaaggtcttgatttttcctgaaccaattcactttcaaacgtaacttttacaacagcatgatttatttttgttccagtaaaccgcacaacgtactctttctcgttttgtagattattgagcgaaacataaagggtatcaccgtttacgttttcatcccatgtattgctccataaaacttcgtctgaatttctatcttttatttccacaatccccctttcgccatccatctgaaaatagacctctgcgtctaaagtttctatatcctcagacacacaaaataagcgtccattctcaaacggatctgaattactgtaatttgcattcatttccatttcaagaacggttttttgtgtttcctcagtatctgatacatttgattgattagcgttggctttttgacacgcgaacaagctgacaacactaatagcgccaactaaaaaaaatagcaatttttttgtgctaaacatttctttacctcccttacaaacatggatttagataaattataacacatagcaatccaaaagaacataacggcaccttctgtacatatgtataatcctggcccatgctccatccccattcaagcaatcttaaacagacatgggcaaaacaacttccagaaaaaagaaaatcccctggtctgctacccaaaccaggggatgtcatctacatcacaactccaacctctcttgattgaatgaaatagatatttttattttgaaagaatttctctccacacatccttcatatgttaccatcatcaacaaattttaacagatatgtaaatttttccgggaaccgtaactcctttggattaatttttttcgctacatacacagtctcagaataattatcctcgtttttcttttttcggaaagtagcaacgattctcagttgatttgtcaggtaagttctgatatcaagattcaagactgtgttcggaacatagtaccccgtttcctcatcaaacacaaaccccatacaacccttcacgcctccagcaagtttctctgtgacaagcacaggcgttcttgctgaaaaatcgccaaccatatttgctgacaaattcttccgaaatagcatcagcaatatcttcaatttcatttccgttgtcccatcggcagccatctcaaattcctccaggcctaaacgtttattgatacatttatcgaaaaacgcgcccgcagcaactcgctctttttgaaatttcactcctgtcaaatgcaggaaacctgtcgtcaagaactgtacttccaatgtactgatttttttatgcttatccatacacacgaaaagcaggttacaatcaatcagattatctctatataattcagcgcattcaaacagtatttttttgtgcctcgcttttgttcatactattttttctcccaataaattttaaagggagactacgacatcttgatgccgtccgtctcccttattgactgattttatcgttgtccgccaacctcaggcccattcgtcctgcattgctttcagattttatcgttgcccgccaacctcaggtccattcgccctgcactgctttcggattttaggtgtcagccacaccagcgagttgacgctcgctttcctacctttattatacgcaatatcaccagaaatagcaatctattttttctacgatgtctactcccctggtgtatgtattaatacttattaatacttgtctttgagtcaagctatatttctcctgacttttccagacatgtcgatataacacccaatatatgtcgcctatttgctctacagaagttctttgatcgtttctataatatcttgatataaatctttgcttcttttggctttactaatatgctcccctgtcaaaccatctgcaccattacacttatacactggcttatgtgcatttaaagaatatggaaccaaactatggagattcggaatttttccgagcatataatcctcttttaaaatactttgtccaaatggacttaactgtttaactatattatttctaacagcaccatcgacttgatctccaaatatactccacccttttgtcatcccagactttgtatctcgaatattatgctgttgtgtaacatatcccaaaaatttaggttttccttgtggcagatcttctaatggaatgccacttcctgatttcttccatcttctcaaattattttcccattcatcatgccaataaataaacttatttcctaaattctgcgttccttttatggagaataaatctggtgatagaggtgtaataaaatagtcacaaccacctaagaccgtccggtttaacgctcccaaatttgggcctagatcaattaatactatttgtgcattacatttctgtgctgcaaattttatatatctataaatagcaatttgaactctaatagatgctggttaaacacttgcactaggccatgtctcgcctagtctatcctcataattattaagatcaatatctccaggaacaagatataaataatctcttataaatgatggctgtctcattctgatatcgccagtattttctgagacaggctggatcacacgatatatactatttcccctctcagaccaactcttttttatctctatatcgtcaatagtatatgctgtcaaattacattggctatcacagtcaaccatcaaagtacagatacccatatctgccaaaatgttagcaatatgatacaaatacgtagttttccctacaccacctttattattaaatattgcaatctgaaccatataaaattcctcctcttttgaattgcgtatcacttttatctgtcacaaaacacgctaaaattcatacaatactttgccatctcgatccctttctcattcaagctgtttaattactgcttctaatctaaaatttattgtctctattaaatcattctatcatatcgaacaaatgtttgcaatacaaaagcgcccatttctgagcgctttataacttttactatatagcattatatcttaactgcatccccaaacgatatctaattcatccaatcaactctggtgattggatgaaatggatattttaattattagcagtctatatctactacaaattaactttcattaccaacttatcaaaatctgactcatataattgatcttgtatcaccctgtatttttcaaattcactttctgcaaatgcttttgcaatttcatgtgtaactttacctttgtccatcaaaatatcctcatcattcatttttagaaaaacttccagcttagatgcccaatcctccattgtcataggaatgcgctttttggcctgcctttctgcataatccagatacattgatacaaactgattcaaatcctgtagctcactctgagacaaatagttcttcgccacgcttacatctgctttaacaatctttccacctggtgcatttttccatgtggtcagccccatatgttcctttttatgatctgccctctcgacaataacctccgcagcagtatgaccatgaatcgcataatgcagtttgttctgcacagtcttaaagaactcctttgtagtaactgcatcttttgaataatcgactgcagtagcgtagatatcggttattttttgatagaattttcgctcactggcgcggatttccctgatctcatccagtaaatgttcaaaatattcctcgtcaaatatttgcccattttctaatcttttcttatcaagcacatatccttgtactgtgtacgtttttaataccttcgttgcccattgacgaaattgcgttgctcgcagggaattaacacgatagcctacagagattattgcatctacgccataaaactttgtattatattgttttccatccgagccagtatgtcggaaattccgacatactgaattttcctccaactccccttcatcaaaaatatgtttcaggtgctccgtaatcgtgcttcttcctttatcaaaaagctttgcaattgcatcctgagtaagccagacatcctcatcctgaacacgaacttctatagaatcttctgaattctgctttgtaaatactaaaaaatccacagtgctgtttctaatctggaatttcttatcggccattcaatcaccccttttttctttccccgttaagctattttaacatgtcgaacaaatgtttgcaactagaaaacgcccattctctgagcgctttttactactttttactatatagcattatatcttaattgtacaccaagcgaggtctttttcatccaatcaactctggcgattggatattttagatattttatttacatttttccgcttcgcccctccgttttttctgcattacagacctactcgatatctttacatatcactttatagtgagcaatgaatctttctccggcaatattttccatctcagggtgcaaattaattaaccgttcataattctcaccctctttttcttttaattgattcaaaaaaacctgatactcacttggctcttttccaataaatgttgcacctaatttttgaaacaatcccaaacttggttcattatttgaataaattcgtgccagaaaataatctatcttgcttatactggatacttgacacataaataatcgcagagcattatatgctaccccctgtctctgatatctttgaacaacgtcaatccctagttccggagtcttggaattgagttcacgcaatgtaatatttcctacataggcgccgtctttcttcaatataaccgaaacacgaatagcgtcttcactttgctcttccacccatatcttttcaaaatattttcggaaaatggtctcttccatccgaccctttactatagatatttcggaaaatagattatagtaaacctctttgtcctccgaaagttgttttcttaacatatattgcgtgttttctgcaagtacatttctatcattaaaataatatgatttatccataactctcctctcttctgcttctctactctgtaaatactaaactattttaccataccgaaacaaacgcttgcaacgcaaaagacgcccactttcggagcgtcttttaaggcttttactatatcatattatttgtccaactgacacaacttgacattattcgacaatcaactctcttgattggatgaaatagatatttttattttggtacttccatcatgctgatatagcaatctaactgctgttctaccatttccgcaaccttctcagcaaacggcgcaagtttcccttccactgtataggactccgagatattataatactccaggcgattttcttatgcaatagacactggaggaaaaccatttgtcataagctgataattcataataaaacggaatgtccttccattaccatcaggaaaacagtggtaagacaaaactctgtcataccacttccattacctataaattactatttacttccattcgcaggataaatattccccaccgccgttccattctagtgctgaagatattcctccgctttctccattacatactttttttaatctttctgaagcatatttatatacctttttgtttaattcaattccaatatagtttcttccgaatttgtgagcaaccgctgctgttgtgccggaacccataaagcaatctagcaccaaatcgttttcatttgtagctatttgcataattctatatatcagctgctcaggcttgggcgtatcaaatacatcttcatcatatatttctaaagccaaaagttcttgcttggcctctttggttgaaccagcaaattcaacattccaaagggtttccggcaccacaccaagctttgaaacatccattattttttttaatcttggaactccgttaccatcacttccgaaccaaatgttattattcttaatttcttcttgcatcctctcctcattgtaaatccaacatcttcctttcggtggcttatgcttcttgcctgttggcgaaacaatagtataaaactgagatttaacggcatgtccagcttggactgataatgtaaccgattgccaagaccctctagtatcattgtccggatttttatatctatccaataacttttgagttgcaggtagtaaattccttttctttttaaatttgtttatatcatttgcatatacaagaacatactcgtgattattggaaaatatttttctattttctcgtgtattccttttttgccaaactatagtagatacaaaattctctctaccgaaaatttcatcgcaacatacttttaaatatgccatttcggagtcatcaatagatatccatatacttcctacagcactcaaaaactttcttaattctaggatagttgtgcgcatcccttctaaccattcgtcatgattcttcgtatctttataaaacttaaaatcatcacctctattatacggcggatcaatatatatcaagctaacttgatgctcatatgtatccttaatgtcttttaataccttttgattgtctcccagtattaaaactcgcggatttgatatcttcttctcaagaaacgatttttttgctattctcactgctaaattcaccttctgcatataactaatttttctgcttcgtagttaatttcgtagttgttatcctgcctattaaacctactatgcataaactgtcccggtgataccaccgacacatctttgtaatacttctgagcgatacttataatatcttcgattgaaagcaatctcggtgtagctccactatttacatcaaatggagaatatgaaagcacaattgaagcttgagctttgcttgcatacatgaataaatcgtcaaatgcctgtggcgctttgctcttaatacaaaaaggagattggtgtctatcgtttcgataaatcgctctacttaatccacctttcccattaggaaatgtagtcgatatttgcggattatcgtgcaagcaaatagtctcaagaatatgataataacggctataatggtatcgcgtataaggcggatccgcataaataacctctacatcaccaggctgcaatcttttcaaaacttccatatagtcatcacagattatttcaaaatcatgcgtattttgcggtaattctacatagtattgcatccatttttcaaattgttcaaaaacatctaattctctatcagacaagattttttttgccagattcttttttaaagaaccatctttatttcttactttcaagggctgagcaaattgcttgccaatagtatttaccacgtccgttgtagcccccataagtgctgccaacattgcattcttaaccctttcattttgtgcaaaggcatatgaagatattgcatcaatatcaatagcttgtttaaaagaaaagtacaaccctccataatatcgcgtgataattgaatccaaagattgtaaatctattcccccggtgtctttaaccatagcaaaagctttttcaagagaaggggaaagatccgtttcactataaggcagattatttaagtaggcatacaaagatcctttttcaataacctcatagattggctccaactccccggataataatgagcctctacactcatcctcataaacaagaataggcttgtaaactatcaagttggttcttcttgtttcggactcttttattctggctataattcctttataatcaaaatcttttggcaatcccaacaaacgtgcttcacagtacacttttgaatagttttgaatatctactgctaatacatcatactgttgaagcaaatactcagatactactcctgagccacaaaacaaatcacatattcttccatttccgtgggtaagctcatctatatatctcttgattggagataacatacgaactttactgcctagataatggactgtcttgacacttgtatccatatttaaactttccagagcccaaggcttggagtgctaggtttaatggtgcttacatctgtgataaatctagcaataccaggcacacccttggcacttttccataattttacaaacccatctacttcggagtatcttgaatctcccggcatcagtaattcataaaggaatgatcttgtagatgcctccgagaaaacaacataaggtctgttcgttccgctcggataaggaagtccactagccgcacttatttcaaaccgccaattgtggctagctaccgaaacacttggtcttgattctgtagcccccaatgttcctgctgaatcaacgttcttcagaagaatcctataggtagcactagtccttccaggcgtagctccaaaatagttttgaaaagatgctttatcaaaattaatttgcttccatctagtgcttgcttttggaacctcaaccaccaaaattctatctgtagcagaaactgtccaaactggactaattgttggtgcaactactactggtattacggtagggattggtgttgctattatggctgatgactttttaggtttagctttagtttttctaagtataggcacagtaacaggcttgcgtacagatgtagttttgggctgggctttatacaacgccaatagtgaaggatccggagcaactgtctttcctgtcgaagatttaggtgccgaaaatgattttgctttttttgcagcacttagattaacggcatgatcaataattggatcattaatatcaaatataagattattattaatcgaaaaatccaaccaatcctgccagtcaattttgagctttgtgaagtctgtattatttaacgcattatacgaatacatttcgatgttatgatacaacccacgctcagtcagattgcccgatccaataatagacagtccacctgccgttgtttcaaaccaagtaatcttaggatgaaataaatacttctttgaatcatgaacataaccgtatacagttaaattatgataaagtttgcaatatgctcttaaccttgtaaccgccttcggatcagtaattgaatcagtaccgacaaccaactcatatttataagttttaatgtaatcgctaaagtctggatcacccaaaaacaaatcaattccattctcttctgcaaatgcaaaagctccagctccgtcttgccccttattacatgcgtcaatcagcgcttctcccagcctcatacttgctgcataggcgggatcttgaatcatcaattccatatctgtacctccataattatactccaattgttacctatagtcaacaattatattcccttaaagaaattttcaaaagaaacattcagagcattgactatcttctccaaacttttaagtgaaatatttcttttccccaattcagctcctgctaaatacgttctatctagctcagcttttaaagcaagcttttcttgactcaattcccgctctttgcgaagttgtttaattcgctgtcctactttttcagtgatcatagcaaatacctccacatatcattatccatgacgttacttataagtcaacggatcatgagtaacacttgctattttgagttaacttttttcatcgcttttcttgactgttctctctttaccccggatatctttctcagcttacggtacttaacacgtgattttggcattgtataggtattgtctatatctgtttcacctatacactgaaagacctctgggaactcggtaactaatgcatcaagttttctcataacagctttatcacgggtgtaaactgtcgcatccggatcctctgcattgaaattgattacagtctcctgcttatatcgtgttagcttaatgtaatttctgttcgtcggaccagagatttgcctccaccttccttcagatcccagctcacgacggacacctttggtcttggctgtatccttcccactactaaagcggattagggacgttcgacattagcaacgtgcgccgtcaggcgtaccaaaaaaaggacgtccatcataaaatatgtaacgccctttggctaatacgttattcaaatttaaatacaaagcaatttgccgctgttatgccgctttctgctggtgtctctgtgttacattcccatctggaaatggatatattttcacaaactcagcatgagtccatgctgctagttcaatcgggttcatctctctgcccctccatgccaaatcagagtaaaaatccttaatcttccgatacataacgctgagagacggaggcgtatgctgtgcaccggagatgtacacatccacgttctggtaaaacccgccgataataatattttccatcaacaatgcatggacattctttacaattttctcatccaactgctgattctttgcaatacactctttcacatagtgatatgccttctggtggttgactgtttcgtaaatctcccggagttgcttgccacctatggtaattctatcctccagcaatacctttgtttcaatcaatgtcagagtattaccctcaatggcggtagaattgtgagtgtattctatttcaaacgcctgctcataggattttaatgtcaattccgggatgagcttcctgccagactgttataattctttttttctcaataattctggataattcaagaaatacactcctccattctcattctgacttcttttctttacacagtataccacagttttgctgaaccgtaatcatcaatttgtcgtcattttccaaagattaaatatgaaattttatgttacattgttttccatcccaccagatgccctttccattctttccacagctttgaactcacttccactgttggtcagtatcactggaaatacctttcctttattcctgggattattcccactgcgtcacagatatttctttgcgagaggatttgagccgttccacataggaagaataggctgaagccacccggtaataataacgggaacgactgccctatttatataacatcatttacttttcatagtgtgcacatacgaattatttttatcacaccatcgtattggagtcccttcatagttgcacgttcattacagacctgataaacaagtcgatgctgtatgtttattcttcttgaatacattccattcaaattaccaacaagtttttcatatgacggtggattttgaaatggattttctcggataacatccaccatactatcgtaatgtctgctatactctttaccgttcgcgtcactaagcagcaacctataagcattcggcgctaactcttatgaattaacaagaacgtatatttgtctctatttggaagccctctcaaactcttccagtcccaaacgtttataaatacatttgtcgaaaaaagcgcctgcatcaactctctctggaatttcacaattgtcaaatgcatcaatcgacaccattcgacacctacgcctccgggaggggttgcatgtagataacatacaaataaaaatgcataactcagccttataagtaaattcaaaaacataaaaaccactttctaactatgctatatatttcaaataatcatgcgtaattaaagtatggctttagtatccaatagactactaatcaattagcatatacctactgatagccatctttaaaggccctgtctaaataactcattttgttttctccaaatatcaatttagttcacttttcataacatcttaaaatcaaacatttttcaaagcataggattatttccacatctgcacatttgcagaccaatgtttagtaaattctctattttcaagtatcgccttaaatggctcatccaaaaatgcttttatctcatccagaacaaccctaaaatcttctgtctctgtatcaatcttctttaaaaacgccttccattttttttgcattccttcatcggtatcaaacgacataatctgctcaaactgatcagcagtaaacaagtggttgcggttcgcaaaggttttccccagtgcttctgctagtatcgcaccatcgaaatcaaacttatttgccaaataataaaggtcataataatccttcatacgactggaaaactccatcaaatcaagaatagcatccagcttttcggcaaccgttgtttcaacagaatatgtattgaccataggcgcctcgaagtcggaaagctgcgttggaatcttcctcttcttctgatgcggtacaataatatcacccacaccaaagtcaatagagaatggtgtgcgggtattcttaattcgtgccacaatagctgcaccaatcccagcgtatttctttgccacagcaatcggcgcgatactcttaacttcaaaagaaatgtagtcgtttccggtttcagttgcaataatttcttcaagaatttcccgtaattgctccattgtgtttggcttctgacgcagcagaaaatccacatccacggtcacacgactgtcaaaatttgtaagcgagtaaaggaacagaccacctttcagaactaagttttcggcataaggagatttttctactcttcgcaataattcttcctgacaaaaaagctgtatgcacaactgataacttctaccgctttctgctgccttatttttcagtcttgcaagaactgatgcgcccatgtcagccattcagcattacctccatcaattcatttactctcttaaacaaacccatttcccttgcatatttggaaagattgcgcaaacttttttgttcgtctgccacataggtgtgaatcgctttattaaaaagttcattgtccaatctggtccggtatttgaaacagtcacaaatagtacgctctcgatcatatatagaaagcgttgtaccgtcaaaatctgctgaaatcttcccaagctcgtaatactggtttggaatataataaacttttatcggtacatcatctattttgatctttgctcttgatatagttctgggaactgcaagcgtccagagccgcggagtgaaatcactgtatccataataaaatagagctgactccacacatacaatgccttctggcaacaaggcctctaaaatctgttcttccgttatatcataattattcgccaatttataatagccatgatgtattcgctccaaatgtccatcatgattcaaattgcatacatcatatttcgcaagaccagccgctataaagtccgctgtctttgcaatacctccctttgagataagcactttctgcgcaatctccagctttgtcatcctatttcctactttccacacacacttttaaaatattgtagttcaatagtagtttatcatggtaactccgattaagcaacgacttttcatattcagttataaaaatgcgattaaaacatatgacaactataaaattcttccaaactgaaaatacctgtctccaaacggtccgcctgctcttctgcatattccggaacctgttcataaatatactggtaaatactgtctaaatcccgcagggcacgctgaaacatcttgattgtatatttattttgcatactttctcctcaatccgctcaatgcctccctggcatccataaggacggccccacctttcatttcagtctccgcttctgcaatcgcagcatcaatctgtgtatcagttatcagcctctcatacgcttcaatgctcatcactacaagatccccatagccattttttgttacaaaaatcggttcctggcttttatggcagatatctgaaatttcattcgttttccttaaatctgtaattggcataatctgtggcataatatccctcctctctttgtacataattatattattattatatacaaaatcaatctatatataacgaatccagactctcatgaatctttcgctcataacattaaagggttagagacatcatcataccgctattcaattccatctccgcccggtttttactaataatccgtatctccctcaccaactgccgcaccaatacatcatcatactcatccgtctgtttaatacctttcataaacttatcaatctccgcaatctgcccttcatgctcttttttcttttcactaagcttttccaagtcacatttctgttccttcagttgctcgatctgttttgcaatcagcctaaatttatcatcatatttccgggaattcatatcttcctttgcagctaaaccagcatatcttaacagttcctcctgtagattgcagattgtcaaatcgatctcttccggcgtggttcctccggttaaatccgccatggtgttcagtatatcctgtttcagttcttctttaaaatgcagatcatcgtcaccatacagtatttcagataaccctttcatgatagctgtatgtagcgcttcttccggcacagtgggcgaatctttacagtattttgttccattcttcaggcggttaatgcatctccacacgacgcgtttctcctgtttccgtttggggttactccatgtggttcttctatatctggagccacattccgcgcatacaacaatctccgtcagcgcgtatctggaactataggcgcccttcagcctggcccgtttcgcccgctcctgctgtaccatataaaaaattgaccgcggaatgattgccggaatcgcattctccacatagtattgctttctctggcccacattctgttttcttttatgagtaaggtaatcctctgtataggttttttgaagcagcgcatcccccatatatttttcgtttgatatcattctcaatattgtagttacactccagttttcttttccggtagcagtcttaacttctcgttcctccagcttatgttttattttctcacagctgtcacctcgcagataccaataaaaaatacttcttacaatcgctgcttctttttcatctatcacataatttccatggatgtccttcgtgattcccatgaaatgcttataattcaaagaaatttcacccttctcaaacttccgcctgaatccccatgtcacattggtgctgatggaatggctttcttcctgggcctggctgctgagtacggcaatcagcatttcgccctggctctccagggtattaatccgttcagtctcgaaatagaccgccactccgatggcctttagttcgcggattgtaacaatgctgtccactgtgttgcgcgcaaagcggctgactgactttgtaaggatcatatcgatctttcctcttcggctgtcgttaattaaacgattgaaattatctctccggtccaggtttgtaccggttatgccgtcatctgcatagattccggcaaattcccaatccggattgcttttaatgtactgggtataatactccacctgtgcctcatagctggtctgctgctgttcctgctccgtacttacacggcaatacgctgctacccgcttttttctttgattttcctgttcatagcttcgtgtatactcctgccgttccggaataacggatacccttctggcctctcttggcattgaaattcccctccctgtaagataataccactgttataaatggatatctccaggtcccggactgtcattgcggaaaatgatatcctttcgccaatgattttatccatgagcctgtttcatcttccgtatcccatattcgcaggtatcctataaaataggcatccccattccatttgtaaatgtaagtctcatatttccatcctgtctgatccgtatctcttttataatttcacagaaaactcttttgtcaaacgatgtgaccggatattccagcgtatcaagacactctgcgatacgttcggtcctctcgttaattccttctgtttgtaataatcgaaaccgttcttttgctaactggaaacaaatttggaccgcctctcttatatcttcatcagactggaaatccaatctattcaggctctcctctaatacctgggtttttacattttcaaggacagcttcatgattgtttgtatttctatataccgctggacaaaccagcatttgattaataacagtcctataaatattccggatctgttcgtccctaatttttatataagcctgtccctccccctgcttacagacagggcaataccaataaacgcttccatccagtcgtccatccgcatgacagcgtctccccttggaatttcgtttgaattgcgagccacagtcaccacatattatcatatttccatagacataccgccctcccatgattacatcctcattccgtttgtcaggagttttatctgttttattcctgcgtttctctttcactcgttgaaataatttttcttcaatgatgaccggatagccatcctttccgcaatatgcttcttccttcagaatgtctcttatttttctgggctgccatctgacattccccagccggttcttcagccccattccttccatatccctgcaaatttgattgactgcaatccctttatccactttttgaaacaccatctgaatgacaggcgcaatgcgctcatcaatcacgattattccatcacatagtctgtacccccagggtatccgtttggtttgtcccatatattccctcatctaaatctataatcagttctaatccacatgccatatcaaactggaagatccgctgatccaatacttctattttcttaatcaattcattcaataccttctttttcacaatcggatccaaacccgcttccaggtctaaaaaagtaatgagattctttaatccctctatctgtttcatacaggaacctttgccctgtaacagattcttttcatccataagttttctctgttcctgatccagggtctggttccgggtcaaaaaaagagaaggttccatataaccttctgctctcattctcagcagtacatgacgctgcatcttaacctctgccagttcctcttcaatttctctgattctgccttctaaacgcagcctccgttccatggcttccaattgctttaacagcggttgaaaaacaagcgcctttcccctttgcatttttctcggaagccgctgcattgctgaacccaaatcctcatcccggatcaattttaatgtgcacgtcctgttattgctatgacggtttttacatctccagattattttattatcacccctgaccgtcccggcatattcccggcttaattttcccccgcatcttccacatacaatatattcacatccgatggatgatgccgttaaatcccttccagcttccgattgtcgaacgcttaagataaaatctatcttttccttatcttcacggcttaagatcccttcatggtcatcactgataagatactgtctggcctggcctttattggtcagctgcctgaatggtacgattccatttgtgattctcttctgcatcaaataatccccgaccattttttcatttttcaggattcgcagcaccgttgattgataccatttctttcccgttggcccgggaattccggaactgttaagcttcccggcaattgtaccgcagccaatcccatccaaataatcccccgcaatcttgcggacaatttctgcttccggctcgtagatgattaattccttctcttcatcttttctatacccataaggcgctttggagagaacaaacgtaccattctcaaatctacggacacaggcccagtgcgcatttttagatgtactcatagattcttcctgtgctacggttccccatatggtcaggattcgttcattttccatgagtagtgtatttaaccgctccttttcaaaatacactgcaattctcatggcccgcagctttcggactgtactgatacagtccaccacattcctggcaaatcttgtgatcgacttggttatgattaaatcaatctttccctcttcacaatcttcgatcatatcattgaagcgttgacgcctctgccgggatgtccctgtaattccctcatccgcatatatgccggcaaacacccaattttcattcttttgtatgtaattgctgtaatacccatactgagcatcaaatgagtgaagctgttcgtcggtgctcgagctgacacggcaatatgcacacgtccttaacctcctgtttttaatttgttcctggtaaggcgcctgatttgcaggaatctctattatctttttttcattcgatgtattctcatccatatgatatcctccccacatccaggaacgttcctcatcttctcttatgcttcgctatatcagaagcatatctgttctgatatttggcaatcaaaagctcatagaccacaggtgtgataaggttgatggatagcatcttttctaatatggtaatcgctctttggtaacggaattctgtcattaattcttccatacattgattcctcccaaacacatccaactatagtgacattgaaatgtcttccccttcaatgggttctcccttcagctcccgctccgtcatcacaggccttcacgaatttaaattgaatatatagcgcttatattctgggcttttaatgcaaacataaggagcagatcggaagattgcatcgaataaattttccattgaatccccagcagcttatcatacttaaaacttgctgttatttcaaaactgtcatctgtaaatggtaacgcatattctttaagccagatatctttttttactgcaacttttaacatggtttctgtctcctgacatcgttttttaattgttacattattacaaggccttgattctgtctttcccccaggtatgcccattcaaaatccgcgtccatatccatactgatttttaatgatgcgttcactgctctcatatctcttgtatccagatgtcctatgtactccttcagcctcgatttatcaatcgttcggacctgctccagcagaatcatcgaatttctctgtaaaccatatttcctgctaattggcacatgggtaggcaaaggatgcttttccattcggcttgtgatggctgccacaatcacagtgggactgtaacggtttccaatgttattctgtatgataagcactggacgaccccctcccagttcactccctactacagggcttaaatctgcataatacatatcacctttgcgcagcatattgattctctcccttcattctaaacctccggttctcaataccacacccacgcagccgtctaagaacagacagctgcgtaatctggcattgaaatcaccttctttccaaatttattcctcgcttctattcgacactactccccgaagcttgtccgaatagactacgggatccgggcagggcagccaacccgcctgcccgtagctaacaggcatcataggagttacacctccgccaggttctctggcggccgccctcattgcgtggtccccggccaagggggctgtgactggacggaagtatcattataggctattcgggattgtggcgattcaatccgccatgaattgattttgagataggtattttccgctcttgccttaaacccttgaaaacgtagatgggttatttgacggaatccatattccgcaggcagtctccgcgtacccctcttctcgcttctgctcctcgcatccgaatagctaacgtaacggattggctggatatgaacttttcaaggtacatggattcaaaaaaatcccttcactattagtccagtttcagaggggttttgataaccacaattacggattttttttgatatttttcatttttgtgaaaaatcacggattttttcatgcatattgcccatgaaaaaatccgtgattttaattaactgttcaaatgatttacgaagcttgttcaatatcatatttttacacttgaaaaagttcagaaacgaaggtaggcctctgcacatcggcaacccaaataacttataacaaaaaagctgtcaataccatctagttctatggaatcagcagcttcaagcatataataacgattggtccagatacaaaagaaaaatctaaaactccttctatctttatgtagttctccccaaccatgatgaccatgtatctcggttggatgatatctgaaaggtaaaactttacaccataacttctgcctgatatcatcaatcccttatttaagacacataggactgtacacaggataatatctttagattattctgacaagaagaatcaccattgccgctttcagtcctattattttgtttttaatgttcaaacaataatgcggttctacagttccctttgtcagcatttcagtttcacttcctttacttctctgctgattcctctcatagtatacttttttctaatacgcaaaaatagtctcttacaaaatttcttctgtaagaagctaataaactaccttggcacgatttaaatatactggtataaaatgacaaatacacattaatcactcacatggttcaaaaaacaccagcaggtattacctactagcaaaagaagttttttatggtctgcttgacaggaaacagttcattttatatattacctattacaattagccaggtctgccagacgcattgaaatgccgcccttggtcatcaggttaccggccgtacaaaaaacacaatagccatcaatgaggtggaatccagtccgccaaaaagacgctgggcgattactgccgtggtaatggtaatctccgggctgaaaacaatggtagccatagtcgcactcataagggcaaacgccactggtacaccgattatcaagagaaccgcaagttgtataatcatgtattctgattgaaatatataactgcatcgtctatgatccgctcagatgcccgaagtgtggcacttctatgttggttttagtggtttaccacaaaaaactgcactatttgaacgatattggaaggtcatgggatacggatagttccatactcctggttctttctttaccgtcagataaattgatgtgtcaaacacccgtataagcgtcccaatacccaccataaaaccatgtccacaaatttctttgccattataatcttttgactcctttacaaatataacacactcaggtaatctacaaagctccctttttgacatctcatccggtttatgttaaactaaaacaaccaaatgatatccgaaccgggttcagttaacacatattatattttaaggagtgattcctatgccacctaaagccaaaacccaggagcaattaacctgtgataaaaatgcaatgattgatgaagctgttgccctgataaaaaaagacggactggataagttttcaattcgaaagctaagtgtgaagatgaacatgtcagccgccaatatgtataactatttttacaataaggatgagatttatatctacattcggatgaggggttttaaccttcttcatcaggaatatgacagtctggtgagccatcttacagatccgattgaacgtctggagggttatatacgcaagttcatctcctttggggttaaccatcccggctattatcagcttatgttcaacacaaacgaccctaaatcctttgattatctgggcacacctttagagggattagccaaagaagaaaagcagaatgccatgaaatcattcttttacctcagggacattattttggagtgtgctcccgtaatgccgcaatcagaagcatatgtcaccgcaacccgtattatctgcgaaatccatggcatcatcagcctatatctaagtaatatcattctggaactatcctccgaattggatgaggtacaggaaaacctgataggacatattaaaatggaattccgggcatattgagtattgctgtaaagatgttagttctatttcaaagaccagtcctattttcaaatatcggaaatggaactggtctttgattttatttcgctttcattacagtaggtaatactggtaatttccaatccttcctacacatgaatcttatgggtggttcccccaaaagcgggaagtcccgcatcctccagtatctttaccaggttgtttatatgggattcatattcccctctgtccggattgaccgcttccatgttataagccatgccaagggaatgatacttttcctctcccagcctgcggaatctcagcagctgtacctgactgacattccgttccagctcagttacaatgaactgcgccaccctccgtacatgatctgctgtatcattcacatccgggatgatgggcagacgcagcacaaccgggattccgctggctgaaacacgtcttatattttctaatatctgttcattcccagcgcctgtatacttcctgtgaacttcactatccatatgtttgatgtcagtgataatcatatcacaatatggaatgactttgtccagcaccgtgggatgaaccatcaaagcactttccacacatgtgtggattccctctgccttgcatgcctttaacaattccagacagaattcccattggaaaagtgattccccgcctgatatggtaatcccgccgcctgatctgtcataatattcacggtcagccctgattaccttcatgacctggtctaaatccatttcctgcccccagctttttaatgcgtccgcaggacactcttcctgacatttcatacagtcatcgcatatattacggttgattccagccactttcccctcttctatgacaaatggattctcttccgcctttggacataccttcatacacagaccacagccttcaagaccgatacatttggcaggatatacccctatctgccttctgagtataaggctctcaggattgctgcaccacttgcagcgaagatgacagcccttcataaaaacctcggtcctgatacccggtccgtcatggacggtaaaacgctggatgttaaaaataatgccctttttctccattcttgtcccctttttctgacaccatgtgtaccatccaacccctaaaaagactcagacactgatttcattcaatatttccattgcctttgccttaggcagatattgagggacaggatatgtaccatggcattccttaaacccggctttacatatttcatccaccgcactcttagggaacttgtcaagggccgtaggtatattaaggcggcggttcaatccccatagactgtccacgaatgaccttgccaattcctcctggctgcttcccttcagtttaactacctgggccagctccgaaaattcctttttacatgcaggcagataaaattccattatatgcggtagtattaccgcatttgcaaggccatggggtatcccgaatttccctccataattgtgggcaaaagcatggacatatcctacataggtagtggtaaatgccatcccggcatagaaggatgcaaccagaagttcctccctggctttcaggtcatcaggattttcataaaccttcacaatgtttttataaatcatgtacaccgcagcccgcgacatcctttttgtctgggtggtagcataaccactgacatacgcttcaacagcatgggtcagagcatccatggctgttgctgcggtgatgtgtgggggcaggcctgcggtgattgccgcatccaggacagctacatccggtacctgctttccgtcaatcaccactgtttttgagtgggtctgggaatctgagataaccgcggcaatggttgtctcagatccggtgcccgcagtcgtgggtactgcaatcaaaggtagtctcatgattttcacttttgccagccctttgagtgcctccggcgggcattgattcgtataggcagctgatattaccttggaagaatccaggacagaccctcccccgaaggctatgattccatcacattggttttctgcgcagattttcagtccgttttttactgtgtcataggttggatccggctggacatcatcatatatgcttatccggataccttgttcccggattgcctccagcattggattcaataaccccagtgtcattaatgatttgtccgtcaccacgagtacattcctgattccatatctttcaaggattccaggcatttccgttacttttcccggaccgatatacgtgagaggcgtgggtttagccattagtgttgtgggaatcttttttgctgctaccatcatctttgcaatcgtatacatactcttcactatctccattttatttactttttaacgtatccttctaaccaaatcgtataggccacaaatcacctggcgcatctactcaaaggaaagttcggtacggttaatgagatccatctgaagcggcttgctcagttccacaaagtacgcactgtatccagctacccttaccagcatgtccctgtagtcctccggcttttcaagagcccggcgcatggtctcagcactgatgatattaaattggctgtgcattccttttttatcaaaataggtgtctatcaaatgaatcaggttatcccgtccgctctcgcccgaaacacactccggggagaacttccagttaagcagtgttccgttggttgcccttgtatggtccaccttggttacggaattcgcaatggcagtcggtccgctgacatcatgggaacttaaggcggtatgtacaggccccatattatccgaggtgggttcccctatctttcttccctctatggatgccccggatataaggccgaaagccacattcgccgaaacgccatatacgccaggtgtataggtgcctcccctggcatttgggcgcccttctatgtttttgcagtatgtattgaatacaaagggggcaaaccggtcagcatagtcatcatcatttccataatgatggaccttgctgctgttgacaagggcatataggggcttattggtctcccaattggatttcactgtatccagaagttcctttcctgttactttcttctcatcaaataccagttggttcaccgtggagaggccatcgatgactgtccctaaaccattggcctgaggacctgtatggttaaaacggcagcctccctctgtcatatccttaccattgatgatacagtccgtcataagggcggactcatagggcgtgggttttaacaacctgtgggcgtggtccattatttcaatacccgcgacaatctggttacaccagtattccatctgtttttcaaaggacgccttgacctcctcaatattcttaaagtcctcaaggctccctgtggacggtcccagcttctttccctgcgctttgcataccgcatatcttgggcaatgttccccacagtggaaacagcgtccatcattaagagccagctcccatattttaggaatattgatatatgccgcgtcatgccatccaaattctttgccgggacagtcaatttccacacagcccaccacggcataattccttgcatcttccagtgtccttcccttggcaaccgcggcagggatggcggcctcatcattgtacaccttcggatgaccatacccggcccggatacattcagctacttttatcttaaattcatcaggcgtttccttgtggagcctcacacacagccagggggtcatcagcctggtatgggcggacgcatcgcaaatcatgaaagacaggtcattggttgcatcatttcccgcttggtctacaccacctaccgtaaggctttcgccgccccatcctcttcctgcgttagcttccacagtcagtttgtccctcagttttgagggatcgccggttttaataaatccagcttccagcaattcctggataaattcctttttatacacgcctttttccatatcctttttataatatgggtacagccattggtccatcctgccataagatactgaatgtccggttgaattaatcagtatgatatcggttgccagcagccagagctgaagggcttcccaggtatccctcgccggtccccctgctatctggcggcagttggccgctatcctcaacagctcatccttacgcatcccttcagccagaaccgccatctcctcagcaagtgttccataacggtgaatgaaacaggaagcgccatccagcgcaatcaacatggcctggtatgtattacgctttccgatgctgtccggaagatgcatctcaagctggtccagttgattgcgtatctcctccttcagtccatcatagcccacccgcaaaagcttagggtaatccgccacaaagtgtcctacccctccataatggtaaagatttagcaggaacatgccaatccccatctcacttcctttctgttcgtcaaaagaaagctggctttcaatatgttctgctactgtccggcccttccaataatccgctattcccctgagatccgccttggtcttttcatctataccatactgatcatgcgcacgcttctcaaagggagcgttctccatctcatccaatatccagtcaaatgaaaactccggataaataggggcgctcttggaaggggccgcaattcctcccaccagaagttcctcatcataaatatggatgtccacatgctccagcacatgggcaagggctttggcggcgcgtatatttgcaggagctgcttcattggccttatacccctgggtgattaacagggcccgctgtgagtcgatacaaaattccctgtccaaataagcgcttctcagccggttcaccctatcatatggcgaatagccgccatgtcctgactggtacccggcaccataaaatttgtcaaaaggttctactccgattgctgctgtgtgtgccatactttttctcctcttcttttctggtccttatatgctgatttcctccgtcctgatgctggtgtcaccaccttaatcgcgttaacttatatatgttaacttaactatgttcagaatacatcatttacttgattctgtcaaggctgcatggcagtttttatgctttagacaagaaaagagcagattctatacctgctcttttccctggccaatcccaagctgattgtgatggagttcccgcatcccctccaccgtatcacagattggtttcaggccacaatggctgcagtccattgtaaagtagtccttcagtttattcatggcgttggtgatatcgtccgtttgcctggcaagtcttgttaaccgagcaaaacgtcccatgtcctctgtcagataaattacctgtgccccttttatcataggattcttcatgtaagcgctgatggccgcgtttcctatccgttccaggctgatgccatgtctgaatgcctctttgcccacacggatattcttccggttctgttcggccgatatgcgggccatgtacccgtcaagagccagcttatacttcatatgctcaagccgttttatttgtgaaaatgggtcgtttccatcaagtccttccacctgaagcatgactatttccccaaaacagccgctttgaccggtgattccatgcagatccggcccgatgatgcgcacaagattcccccctgcaagctccctgcctgtcatcagggtatactccacgcttggcgccggcgcccgccccagttcgagtttcttctcctgctcaagaatcaggggctgggacggaaccgaagcccacgccttggcgggatccgcgggaaaaacttctcccgcgcttcccagcacatccagggtctcctgtatgattgaatcataataatgaatcacaggcgcacatccctttccattgtgttatagtgtttatccagatactggcgaaggaaacggaccagcttcatatccagattgaaccagtaaatgattcccagcagtacaccggctgcagctcctattttcaagatggtcttcacaatccagcgctccgatgacaacagcccgttataaagcaatttcagcagatggaacatatatttacctcctcctaattttgttttgccatacccttctgacgcgcgtattccgcagccccgagagctcccatgagctgtgggtcaatggaaagttccaccacttttttcttcaggacatgttccagggccttctgcagccctttattcttggcacagccgccggtcatggtgatattgccgtccgtaccagccttttttgccatgacaaagcatctcttcgctaccgccagttcaatgccagcagcaatatcctccttgggcttgttctcggcaaccagggatattacctcggattccgcgaacaccgaacactgggctgtaatgggaatcacattcttggccttcagggaaagcagggaaaactggtccaaatccatctcaaaggcagcagccatggcctcaaagaagcgtccggtaccggccgcgcatttgtcgttcatggcaaaattacggaccgtgccgtccttatcaacagatataccctttacgtcctgtcccccgatatcaatgattgccgtgacgctcgggtcggtgatatgtacgcccattgcatggcagctaatctcggaaatgttctcatcagcaaacaggaccttgttccgtccgtatccggtccccacaaggtaggacaggtcctttacttcctggatacatccgcctgatttaccgatggcctcatccagggccatgttagccgtatcaacggagcttatcttgctgcggaccgttgcattgcttaccattttaccattttcatctaatattacacattttccatacgtggaacccacgtcacacccgccaaaatatctcatgatcattctcctttcaaatatactgctaccatgcaaggctgtcgtcaaagtctaccagggttggatccaatggctcttcctgcatgacggtatacataaacttattgacctcttcgcgcatatccctgcgtgaaatcgtggtgcagtccatcaggtcctgctttacccacagcatcttgatacccctttccctggcctgctcctcgaacatccccgccaggccgtccattcccttacaggaaatctggtcatacatgattaccatgtccgcgttatattcctccacctggacccacagctcgtcaagcacattggcatagccgccctttgtgtgcttgcgcatgatggcacgctggtaatggagggctatatcacgcagcatggtttcaggggcggaggtgtcgaaccggatggtggacacattggtctccatatccatcaagccgcagatgccccagcagttttcaagccagaccgggaagtccgtgtaaatattggccggacaggaccatagaatggcgcggtggcggatttccctggcgcgcttctccttctttacataggctttctgcataaggctgctgagttttttctccacatccatgtagcgcgggtcactcatggcgccgccggcaaaggagaacatgtggaacagccatagggcagagcctgtaatctgcgggctttccgtccggttatattcccatttttccacttcaaaatccgtctgttcattatagcgtccgcaggcctcccgaagggcttcccaatcatatttgactcctgccaggttttcaatatactcaatacatttcttcaaatccgttacagcatactcctgtacttcctcctcattgtatctcagcggcacacttaagacatgtgtgggcaggttcagtctgcgctccaggaaagaggaagtcatgacactgccgtcacagggcatgttgcaggcaatgtaacaaaggccgaaggcgggataatcgtcttcaacagccagtcctgcctcagcagaaggcagcgggcatacatcggccggaacaccgaagctttccaccgcatccagataatgcttggtcatatgctgctccagcatggacggaaagaacagcgtgggggactgaagtggaaaactcagcagggtcgggaagccggcccacagcatggatggtattgtctcgtcaaagataatgatccgcttggcaaggggattgtctcccaccagatggggatccaccttccccatgagcatgattgcggtcaggaagtttcgcatgaccatattatagcttaaatgggacgtcctcagttccgtccctctctgtccaatggtgtgacggtccatgaaggccggaagggtcatataagtttccatccagcggtagcgcagcaggcagtcctttatccctttggggttatcacagtaaaggctgattaaatccttccaggtaatcagccagcggccaaagtcatatgccgtatcactggcgccgcgccattcccggtgctttaaaatcccagtcttgtctgtgtaaagtgaaccgattcccttgggcttttccggcttttccgccattttggacatcatcttcccggcagcatccagaacgtctcctgcagcacccatcgcttttccaaggccctgggcggcctgtgacggagtcggggccgcttctatcaatttatcgatgtattctccaaaattccgcatattcttacccccttttaccatggatttttttgatttcaagactctctacaaatgcctgcacccgggtgcggagctgtccggtaccggtgcgcaccgtatactgacggtcaacggaaagcgtggggatgccgaattcctctgtaagaatatggaaactgagcgccctctcatatccccagtattcgcagaatttaagctgctcataaatgaccccatccgcgccgtaatcctttaccagccggcgcacaagctccttgcggccatccaccttttcccgtgacatgaaccgcgggcactcgctggcttccagataatagcgtactatggaggtgaggacatccccctcctccggaatgacaatgggctcgcgcccggggattgctccaaagcagaaccggtcggcaaccacaagggcgccgttctgctcaatcagctgggtaaattcataatcatcaatttcagagcccaccatcaccaccctggccctgtatgttccggccggatccggctgccgggttcggatttcttccagtgtctcccgcaacaggtcaactaccagctcctttggacaggtgtaactcaccaggttcaggatatgatactctgttccggtaatccttggacaggcctccttgcggaattcaccaatctcactcaggatacggcagacctcattatgcttttccactgcctcgcgcatcttatgatccgagtagtcgataccgtatttctcactgagaggtgtgatgattttctgacggatctgattgacaaaatgttcaacacaatggtcatccgtcttaaagggcgcgtccaggatggatacgaaaaacgattcatttggaacaatattcagtaaatcaaaatgctcggcagcccggtgcatctcggtgcaggtctcggaggcaatcagcgctcccagaaagttatatccgccctcaataccgcgctctacaatggccctgctatattcgcacacataattgctcatataataagtggaaatatccaggctgcccatattaggggtgcgcagccggacactgaagcccttatccacgttcagcagtacctctggtatgaaataacaggtatatcccaagggtatctttccctcgccggcagcctgctgtaccagatgattattcacttcatccagaagttttgtaaaggtatgaatgtgttttaaatctttcatctgaacctctctttctctaaatgataccgaacgcggccagcgcttcggcaacgcctgtcatgacaggtgaagtcccggacagtccaaatacgctcttcccctcgatgtcggcctgattcagtccaaaatcctccgggatgaaggccaatacagggatgtcgtccgtctttatcatggtttttatcttctcatcccgtatacggttcacaatcagccctgttttctggtacatgacaagctggtccgccacctgccggatgcttcccgccacctggattcccttgcggctggaatcgctcaccagcaacagatgggtcactttctccatcacgcgccggttaacctgttccacaccggcctccccgtcaatcaccacataatcaaacttctttgacaggatactgatgatatctttcaggtagctgtttaccttacagtagcatcccgctgcttccgggcgccccacggcaatgaatgcaaaaccttctccttccacaagggcgtcgaggatttcatactccgcgtcattgagcagttcaatggcctgacgtgtatccccctcctttaccttattgacaaaacccatgcggatgtcgtcaattgtcttatgcacctccattccaagagcggtagacagtcccacggccgggtctgcgtcaatggccaggatacgggctcccggtttcttctctgtcaggaccttaactatggcggcggagatggaagtttttccaacaccaccctttcctgttactgctatgatttttgcttcctctgtcataaccatcctccttttggttttcccgaagaacctgtatcgggaatcggtctgtattattttatatagcaatttccatgccaattcggaacacccggatttcaacgcagttacgttggttcaggggcgaatcacgggtctgtgtcattcccattcccaccactgtatcattggtgggattacattgttgtgctaatagtccccaagattaatctggtactttttaatcctgcggtagattgtggacttgctcagtcccatggaaagccctgcctgcaccacatcgccgccaaaacggtgcagcgcgtccataatctgctgtttttcaaattcctgcaggctcctcccctcactgctgctttttcctgcatgggccgccggggcttttgaggaaaacacctgctgcctgacatcgggaggaagatcattggtcacgatttccacatccctgctgcaataaaatgccctgacaataatgttatggagttcccgcacgttcccgggccaggaataagacaggattgcatctgtgaaaggttgggaaaaccgcttctgtatacccccttccttgacgttcattttatgcaggaatacctccgccagctccagaatatcatttccccgtttccgcagaggcggaatgtcaaattttattacgttaatgcggaaatacaggtccgcgcggaaattctggtcctgcacttcctgataaagattcctgttggtggccgcaataacccgcacgtccaagggcctctcctccctgccgccaatccgcatgacccggtgattgtccaatacccgcagcagcttagcctggatttccagaggaagttccccgatttcatccagaaaaatcgtaccgccgtcggctagttcaaatttccccggattgccagtggcgctggctcctgtaaacgcccccttctcatagccgaacagctcactctccacaaggctcctgggtagtgacgcgcagttaaccaccacaaaaggaccctgcgcacggctgctggcggaatggatggaatgggcaaacagctccttacccgttccgctttcaccttcaatcaaaacactgcagcccgtcctggcaatatcctccatggtctggatcagggtccgcatttccttatcctttgttatgatatcttcaaaggaatatcgggactggttacccgcaagctggttggtcagccttgtaacggtttttccttcccggaagaacaggacagttcccgtatattttcctctcagccggagcgggagaacggtgactgaacaggaaatgcttctggaacctacccgcatcttatattcaggatatgtaaaaggctcactttcggctttcagacgcagttcaaagtcttcaggcgaaagtagggtccgcaggtccatggcattcagttcctccatggacaccttcagcatggcacacatgttgcggctggcccttgtcacgcaaaagtccgcatccaggacaataatcccttctgagacaacggaaaatgtgtcatccataatcttcaggtccagcatcagttccagacttttctctatggcaaacgccatggctgacacaagtcccagagtgtacgggttgctgtcagagcagcggctagtcatattgatacagccaatgaccgtcccgcttttatcgtgaatgggcgcagaagaacaagtcacctcgctgaggcggaagttatagtgctccgccccgataatctgaagttcccggtccaggaggatacttacattgggtcctgtggttcccatccgctcctcagaccattgcaccccaacacgaaagccgggtccggaaaaaagttcgatatcgccggcaaataccctggccagcagacggcagtctttgtcgtgaagcgtgatggcatgctggctgcccgccaccagttccttcattttcaaaagaaaaggccaggcaatatcatatagaagccggttatcctcaatgattttctgtgctccggcctccgtcaccttctcatccagctcctttcccggtccatagttccagcagcgtttccaggactcagctatgaacggacgtacctgaggatggattgtgccgtgcttgataaaatcactccaatatttttttaatgtctcctgtttttccacaatacacatccctgaaccacctcctttttcctgaatctatccttaaacgcggccggcgccgctgggcggaattagtgcacaggacggtacaagtagtttcccgatgcgtctgtcaggttataggcgcagaagggaaccagctttttatcggcggacaggacctggacacggcagcggcgcacccggtccaagtccagattccacacatcctgaaactgcatggcggtgaccgtcaggctcctttttcggaaatcatgtatgaacgcatccaggccgtcacagcagctgtctccctctggttccacgcgccacttatcctttacaaaatcccggtcctttgcaaccgggtctattttcccacagcagtccccttggcctggccgggaagtgcatgtgaacgtattgtccccattgaccaggaatgtggaataaaaactgcacaggctgtgtcctgaggacaaggggtgcatatcctgcctgcggattgcgccctctgtctgcctctctatttcctccatgatgtcaaacatggtacaccgctccccgccatgttccgggtaccttcccatataagccgcaggctggaaatggattcccttcacaatatcacaccggtcagctgcataccggattaatcttcctatttccccctcattcatccccggaaatattaccggtacaagggctacgggaattccggcctcacggcagctgctgattgcctgttcctttaccgccagaagggactgtccgcgaatcagcatgtttatcctatcatccgtggaatcaaactgcaggaataccacggaaagcccggcatcttttaatctccgcgcatatcctggctcccgcgcaagcctcagaccattggtattcagctggatatatggaaatcctttttttgcagccatttggattatttccggcaggtcatcacgcatagttggttcccctcctgataactggaggttaaaaggtctttcctcccccaaatcccacaggaaatcataccagtcttttatcgtttccatagatggttcttccgacaccgcatcaccggatgatgcataacagaccctgcagcacatgttgcatcgggcagtcagttccagcaccacacagcaggctgtctggagatgcctttcacaggtcccgcaatcaaagggacaaccattttcatggccggtaagcggacgcttcggcggtaccgggtggtccggcacggccatccagcgtaaaaacagctcctcgtctttggaaacaggtgttgtaaacacgccatgcccgggacattcctttgtaaaacagacgtttcccgcatctcttacataccgggctttcacccgtttcatacataccgggcaaaggctgtctgccgtcttctgtccatccatcctcttatcccctctttccggctgtcagctggaaatatcccacgccgtttaagccacagattctcttgtagtattcatattccgccgccagttccctgtcctcgtcctcacgcagggccccattgagaagaaattccaccatgaattctgtcatcaatcccgtatagtcctccatcccggttatatcaaatcctatttccgtcatggccttagcgacctcatccagcagaagaacaccatcaattccacaatcatcccggtcagccagttcctccatggtccggcagcagccatcttcctcccgggacaacggctgcccatgggtgttcctgacttgtgacagacgctgcagctgttcctgtgaaggttctgtgagacacggggcatggataacaatggtccccttatccttcaggacacagtacgcctcatgaagcgcctccttccggttatatatgcatggcagtgaacactccatcaggactccatcaaacattttcccatcaaagggaagctggcatccgtccccctctatcagattcaatcccggatacagctccctgcccagcaggatccgctgtccgtcaaggtcaatgccatacgcgtcatatcctgccgccgcaagatacgcaaccgtgtccccccttccgcagcccacatccagcaggcgtcctcccggcgggaaacctccggaccggattgccctctctgtgagaaggaatcctcccggtctcaatccttttatcacccttccaccttctttcccatgaatcacaaatgcctgtccgataactcccttacagcatcaagggcctggcccacttcctcttctgtattaaaatagctgaggcttatgcgtattgcgcctgcctgcccggttgccaggctccggtgggccagaggtgcacagtgcagccccggcctcacgcaaatctgataccgttcatccagaagtgccgctgcttcggcgcttgtatatcctctcatgttaaagcttatgaccggcacacgcctgcaaggctctttgtctccgtataccgtcactccccggattcccagaagcccatccatcatcaaagaggtgagacgccgttccttttcctgtatggccccaatccctgtgtgccgaacaaattccaccccccatcccaaggccacaatccccggcagattgagcgtaccgctctcataccggtccggcagtatatccggctgccttggttcggaagaataactgcccgtccctccctgcttcagctccttaagttcaatatcctcccgcacatacagtaagccggtgccgtggataccaaaaagcgccttatgcccaggggctgccaaaaggccgatgttcatttcctccacattaatccgcactactcctgctgtctgggccgcgtccaccagaaaaataacgccgcgcctgtgacaaaggcttcccaattcttttaatgggttcacgattcccgtcaggttggaggcatgggtaacagccagcagtcgggtattctttttaaacacctgctccaccgctcctacatcgagaaggcccgatggtcctgtgtccactaccgtatgtgtaatcccctgttcaccaagggcgtgtaagggcctcagtatggaattatgctccatggaagtacataccacatggtcaccctgcctgaggacaccgtgcagggccagattcagcgcatctgtcccattggacgtgaatatgacctgttcagggttggcgatgccaaacatccctgcaatacactccctggtccggtatacctccctggacgccctggctgcgggcatgtgcccggaacggcccgggttggcgcaatatccacgcaggcattcatcgaccgcatgataaaccgcttccggtttgcggaatgtggttgccgcattatcaagataaatcatgttcctctcctttccggataaaattactgcccacgcaggtacattcccgccggccatctttcctccgttctcccaaggtatacagcgcggcccggaccggcatttctcccaggaaccgaaccagctcctccctgcctccgtccaggaaacgcagggcaaacccacagtccctgctgatttcaccaggcgtcggtatgaccactgtccgaaaacgtcccagcgccatcttctccgcacgaaggcttgcgctgaccgtggcaaaagccatcacataaaaaccttccatcatacagcctttctatatatgaattacccgctttgcagcatacatcatccctgcaatctcatacatgttagacacgccgccaaccttaagctgctgctccaggccatagtaattcaggcacgcgccacatgagacaatgcccacgcccttggtttccaggatgtcaagtatatccaggaccggggacccctctgttgtcagataaaccccgctgttgaggaacgcaatgtgttccggcagttcatcttcctcgctgagcgcatacaggtatgaactcatcagtttttcccctagctcttcgctgccctggccaaaccggttggcagttataaggataaataggggactgcagtccctgccggcggcgctttcctgttccgtatccttagcgattgtcaccgcatacccatctccatcttctacgtgggagcaggaccattggcgtcccctggcaaactggtacagattgtccagggcgatatcattatccaccaacaccagcagcttggcgcaatccggtggttccagcagttttttagactcaattatcggttttgggcattcccagccccgggcatccagcttcttcattacatgacctccttgttttttccggtttttcaatgtaatatggcatccgctgcataatctccgcttcttgtatccgtttctttcccagacgttcaaggctgcatctgaataatggttctgcacgcagcttcaggcggacgccatgacgtaacagcagcccttccaaggcagctgccatctcctccgggacctccggtttcccattcagcccatggctgtagacggtaaacagcgtgaggtccagatgtccgggcaggccgtctgtgtaacatgcctcataatgaacggccctcccactggaaaatatcacatcatccagccccgccgttgtcaggagccagccgtccggacatcttaccccatcccgcaaccggcctctcaccttttccatgtacatcacgccgtccgcctggtttcccatgtccttccaggaagccacatcccctgtcctgtaacgcaccaggggcatagcctgggcagtaaggctggtgaatactacctcgccggccgttcccgccggcataggacacccggattcatccacgatttcaaaataaagatcaggcgtacgcaggcaatatccatcccccgcagcttgggacatacctcctgcaaatcccatctcggtcatcccataatgttcgtggaccttggcgtcccaacgtgtttcaatgcgccgcctcagtccgtccggcacatagtccgcgctcagcaacacggatctgacctttatctgcggagtcatctcagccaaccctagtacctgtcctggaaggccaaggacacagtttatgtgtttctcctccatgagccgggccgctgccgcccatccatccacagattcccgcggatatacatcaagccccatggatgttcccgcacggcagagtaattcccccactgaacctggtcgcctgcatggaaaaagcacgaacatggcatcctttccggacaaccccatctccatcaaaccctgtgcaaaaaattcaagcgtcctttcctggtctggcccggaaaaacatatacgttttacctgccccgtacttccgctgctggtctgggtcacgatacgctcaaccgccttctgcggaacacagagcattcctgctccatgggcagacacctcttggggaaatgtaaatgcaagtgttccaaaatcctttagcgtccgcagcttatggggatacaccttcctgtatttcatctggtaataggggctgttttccttcacgtaaaccaacatctgcctcagacgttccatctgcagctcctgtaccggcgctggcgtcatggggcggccattcagttcccgcgcccacttttctttaacccaatcctctaccatatgtacctgccttcacgattctgcctgccattatttctcttccagtatttcttctacctcacgcattttacgtcttacctgttccggcacatatacctgcccgcataccggacaggtcttaagctccacggtatatgtctgccccagataagtgacttccgtcctgcgtccaatcatttccagaccgcacctcagacactgtatggtttcgtccctgctattctccatttacacatcccccgtcaggctgtcactgcatacacgcatgcggtggctgtagcagttatatatgacaatatccccatccggattcaccgtatactccacccaataggtaatgacgcccatacagcgcccggcaatccggtggccggtggccgcgttcaacatctccctgccgcttcccatggcctccaccaccacgttccgtatatcatcctccagcatacattcctggtgcattttctcacgaagtccagggctgattatcagtccggtgaccggcagccgtttctcctctttctctccccacatttccatcagctccatccggcatcccagccgtgcctttctccgttctgaaaagtcaaaaggcgcataaccggcagcgtctgcactttcctcccgcccaaacataagctccagcagatgaaggctctccttcccttcgtattgaaaaaagtccctgcagttaccgcatgacgtcagatagggaagcgcggactgggatgtccgcttcccggtggtctgacgggaaagctctggcgcagtatggtactgcagtcccccatatccgcagcaaaccgtatgatcacggttctccggcaattcatacaggaccgttccaagggcaacggccactctcctggggctgtcctgcaggttcctgcagctccgggtggtacaggggtcatgccacgcatattccatgggcatattttttctctccaatggaaaccattccaacgcctcgctgataaaaatcaggaatcgttccggaagaaactccctcagcacccgccagcagccaggacagaacacaatcactactggcttttccatgttttcccacaccttcaggattttattcctgaccgcgtccgcccgttcctcctgtcctgcctgcctggctggcgcaccgcaacatgagagcagcagcccaactccaccaagacgcgcccgcaaaaactccaccgtccgtctggtggttaagggaagtgacgccggaagctgacatcccgggaaaagcagatatttcgtcccaccctccccgtccagggacaggaaagcttcattacagctaaaatccatatccctcaatgggtaatggaacacggctggcggcatgatacccttgcgtgtcatggcccgccgagcctccaggttaatgtcacccatgtcaatcccagccggacaccgcccgccacagccgccacacaggttgcagctctggataaaccggttggcgtgatgtgccccccatatctcgttcacattttttacaaccgttcgtatacactcgccggaatacttctgataatggcttaggtagacacagcctttcatacattcctcacaactgcacagaaggcaccttgccgcttcgtcagatgcctgctccctggtatacagattctccggctctattcctgttattttttcatatccggcggccggcgggccaatcctactttctcctgtctcatccatacggttggcgcggatggaaacctgcttcaggtaacggtcaatggatacggccgcccgtctcccgaaggcggccccccctgcttttccggtctccggtccggccatctcctgtgtcattcctgcaaacacgccctccatatcagtctccaatgtcaaaggatttctggaaaagacattttccccgcccccggttcccagatagaccacgtcaaacccggcccgcatgtcaaggagggtccggccattcaacggacaaaataccgctccgcgctgcgcaaggaaacccagttcctctgcccatatagtttccggaacctggaccggccgcctgggcgcgtcaaataccgtcaccccataccccttttctaaaaggaaggcagcagcaaataaaccgctgattcctccccatattcccactgtcctgcccctggcaggtgcaggagggaaagaactggcttcaccgtaagccatgcaggcctgttccagctcctttaccctgagtccgcagtccgtgctgctgcgcacacacgcccttgaacacatcccatcgcaaagatatgacagaataccaggaagcaggagctggcgccgcataagcgccctgcctcctgcaaagtcctttgcttttaccttccgggcaagttcccgtatatccagatgaaagggacaggccgccccacagggaggaatctccccgtgaaggcatttccttgcaagcccgtttatctgaaacatcctgtcccccatgtgccgcacctcctttgtcagcttcttcagacacgttccagcgccgccagcaccttatcaggcgttgcaggcagatgggtaatccttacgccgcaggcgtcatagattgcattgataatggcaggatgcggcgccgtggtgggaagttcaccgcatcctgcggatccaaatggtccctggggccggtaggtttcctgacagataacctcgtaatcgtccggcacatccaatatggttggaaaaccgcagccccgcatggttgtatgctttttcagatcctcaaaattttcagacagcgccatgccgattccctgggccattcctccataaatctggccttccaccagcagcctgtttccaatcttccccacatccacggcgcctgtcatactgacaaccctggtcttcccattggaagtatccacctccacctgtgcaaggaaaacagcgtacatatatgtaataacaggtttatactgcatggttgcggggtcaatcatggtgcagaagggagctgtggtaaaactgcctgtataggcagtttcaaggccttctgccttcatttcctcataggtgcggaaacttccgtcatcctttctcatggcgtccatcaatttttcacatgaattcacaattgcattcccaaccacgaactgactacggctggccgcagccggtccgctgtccggacaaaaagccgtatcattcagcttcgtatgtatctgctccggcctgatacccaaatccctcagtgcctggtgagcggtctgcagcacccccatgtcacctccctgtccatggtcctcccaggtattatatatagtgacgctgttgtccgggttcaattcaatcctgctttccgccgaatccgccatatcggttcccacgttatagactcccacgccaaggccaacgcccctgcgcagggttccctccggcttccggttaaattcccgggattcggcctttaaacgctcatacttgggtttaacaagctccagaagtccgggaagagggtgcacatcaagctcgtcaccggtaggagaggtactgcccggacggaatacatttctgtagcgtatttcccacggatccagtcccatcttctctgccagcacatccatcagcacctctgaaccgaattgggactgtggcgcgccatatgcgcgcatggctgacgcaaacgcatgattggtaaataccgccctgccggaaccatagatgttgggtacatgataaccattagctacgttcctgaggattttggctgtaagaaggtctccaaattccgaatatgggccgtgatccatggtaaagtcaaacttggccccggtcagcataccgtccttatccgcggaaagctccatgtccatgaacaccggcgcccttttcccggtataggtaattgtctggtagccgctatattccatgtatgcaggacgtccggttgccagggtaaccaccccgcacagtgcttccagggtaggacttaatttatagccgaaggtaccgcccattacattctgcaccatccgtatctttgtggggtccagtcccaggccggcagctatcatggcacggtgggtgtagatgtagatgctctttgactgaattaccagtgtatccccatccatataggaaaatcccacgtccggctctattaccaggtgaggctggcgctgtgtatagaaattgcccctggccctgtattcgcttccttccagggcctggtctatatcctgcccctttattatcttctgttcaaagtacacattggggatacccggatgtatttccagggcatcttcttccatggcgtcaagggcgttcatggctgcgggcagttcctcatattccacctccacaaacttggctgcggcatcggcatgggcaaatgtatccgcacacacaatggcgatggcatccccaaactggaatatcttttcatcgcagagtatgggccgctcaaagccgtctgtcttactccacgggaataccaccacgccgtagatacggtttttaccctttacgtccttataggtgatgacacgctcaacccccggcattttctctgcctttgatgtgtcgatgttaagtatccttccatgggaaatctgtgcctgcaccagggccatctgtaaagtccccgcgggaagcctggctccgatatcagcgccgtattgacaggcgcctgacactttatccttcgcgcttggcctgggccttctggttccccacacagtcccgtccgcaggctccacataatccagaaagctgtccggctcctcccccctcatcacctttgccacgtccatcacagcgtccaccatgggcttgtatccggtacaacggcacaggttattatttttgtagaaccaatgacgcacatcctccctgctgggtgactcattctcctccagcagcttggtcccggaaacaatgaatcctggtatgcagaatccgcactgtgtacatccgtgctttacaaatgccctctgaagccggcttaaggaatccggctgtccgattccttctaccgtggttataaccgagccatccggcacattcttcatcttaacgacgcaggaacgtttcaggccgccattcaggattacggtacatgcaccgcactgcccattcccgcaggccattttcgttcccataaggcccagctgttttctcaggacatgaaccagtttttcctccgggtccgtaatcagctcgtatttttttccattcacattaaaattctttcgctccatatgattcctcctcatttactctgaaactggccgaagcttccaggttggcctgcaccatttccgcatagctgcggtagctaccgtcaatccggcgcattgtctccagaagccgccggcaggccttttccacggcgccgcacagggcctgcagccgggcatcttccgtgtcggaggcatcatagagacgcatatagattttcttcacaggtatgtgcagtggctccagggttttatgcacagtctccaacaccttaggatggccccccacaggttcattgtcaaaggtattgcggactgtcacacttccgtcaggattcaacgccacctgtacctccagccatttgccggcatcaggctcttccctctccgtcacggatacacaattcagataatcttcacacataggatacctccttccatggttacgttaaattaaacagcaaattatatgccaatcataatccgtcccatttataaggttttttcccattcctgtgtcatatttttcccacctggtatcaaaaccgccactatcagtatcaattttgacactgatacaacattgcgtaaataacggtggcgtcagtgccggatatctgcgtcaggtatgtatctgattccaaaatcctactgtaacatatgcacgaaaatatttatgatatttgtcattgacaaatctgtccagctactcttatacttaagccaatcattgtcttgaacacacaggtgccccccacaggcatacatttttatccagaacattcaagaggtgatatgatgagcagttccaatacaataagaaatttttttaaccgccttgccccttcctggaaggatgatgcgggctttgcccctgtccgtgatgaaatcaccacacgggccgcgtttcctgcaggctgcgccatcgccgatatcggatgcgggaaaggcgtcatggttccccatctcatgtatgcaaaccccagacagattattgagctggacctgtcggacgaaatgatgcgtcttaacagggaccgctgggccggggaatccaggattacttttatatgcgatgatgttttaactgcaaaacttcccgccattgatgctgcggtcatttttaacgcctatccccactttatggataaaacggctctggcggaaaaattaacatatacgcttccggcaggcggaacactcatcatcgcacacagtatgggacgggattccattaatcagattcataaaaacaagcgttcctgtggggaggtgtccattccgctcaaatcccctctggaagaatatgaaccctttgctggacatttttctctggatgactgggaagacagccgccggctttatttcatgaggctgaccaggacagccagctgaacaaaatgttcagacatgccccagggcggaagcagatacaggatatctgtttccgccctgtatgtttatataaatgacggtttttcctagtcaatcaaatccatcctgaatacttcaacccagaatcagattaaccccgtttcgttaacatagttcaattaaccatattcagattacattactccatatagcttgtcaagatactgcggtattttctatattttatatgattttccatgtgttttcatgtgcatagtgcacaagcttttttacataaatatacttttaatattttagatgcacatgggtacctgattgccaatttcagttgaaacttaaggccgagagtaagtaaaaaagctgtggcttaaagcggtctcattgataaggatgtttacgagaaacaagtaagttaaggcaaacagctgaaacgaaactggtaaattgtaaatcattttatcaaggaggccgcttatggctatcatggatttggagtatatcgaaattgacggattattttacccgaacattgaggttgagggcagcgagctgctaaaaaatcttggaaagtacggacacttgcgcttggagtatcttcacggattcaagcaggaaatgtaccgggaattgcttttcacaggaaagctggcagagcattgtgctgcggtggatatgcgcgcatttgaactttcggaacgtattcgcgtcgattatctaaaacagcaccccatgccggaggaggatgcgctggagcgtattcgtatctcggagcaggcacaggccgttgccgatgaaattgtaaaaacagaactgatttatgtgtaaaaagaagctgtgtcgctcgaaacaagaatcgagcggcacagcttcttaatttagatcgtgaatgcgatatccagttccatataccctttcaatcctcatctcttagtgtacaacttatgttaggtatttcatggagtaggaggggaaccaatagaaatgtttaaaattgattttatctatatacttccatattcgtgcaaaaacatggaggacaatagttctctcccgatattcgtcttaataaccgtaccattgcatcatagacagtctctttggatttgcgagtttatcccatatttaccaaataatatatctccaataaaatttaatggtcgatatcatgaatgttacctttgtaaaaagaaatcatttgttgaatagcgtaacttatttttatcactttttcatcctcccttcttccgcttttggctctggtgttacttttttcagttcaaaccagaaaatactgccttgtccaagtttactatctacgccgaaatcagcttccaacatcaataaaattgatttggtaatggcaagtcccagcccagatttgtttatatcacttctccggttttttgatgtgaaatatctatcccaaatatagggcaattcctcatctggaatacccggcccataatcacgaatttctacccggacaccaaggccagcctcccgtaatgaaacataaattttattatttccagaatgactgactgcgttgtcaattaggttatataatacacgtttaagcagtttctcgttgccgtttacccattgtctgggttcaagcgaaattttgatttcacaatcgctttgttcacataggggtataaattgttctgcaacgcactgcacaatagaacttaagtcaaggctttcaaattcaacagataaattacgtgactgcatagctgagtattctaatatgtcattgacaagtcctgtcagtctatcagcctctctaatgataatagctaaatcatcatcccgcctgctttcatcgttccatgaaatatcgcgaatcatttcggcatagccctttatcatggttagcggcgtccgcaagtcatgggatacattggccagcagttcccgccgtgcgttttccaattgctgcaaagcagccgtagtttcttccagtgtggccgatagattatcaagttcctgacaaaagcctctctcataatcgcccacaaattctcctgttaccatgcgttttgcttgtgttgaaatagcaaatatcggtctggaaaattgtctggataaaaaatatgcaattataaacgcaataacaaaagatacgaatgttacccaaataagttgtatgcgtaaaatactggtcgtcgcgccaaccgctccaagctgcatactaatatataaaacggctttctcactgccaaattgtacggaatccggcagcaccattccataaacataagccgtattattttctgttggaaatcctatcgttccatcttggctagaggataactgttctaaaaaatcagaataattttgtggcagattacgatatgccccaatctgccaattcataggttcatcggaattccgataagggttgcctccgctgttgttttcaatattccaattttgatgtttttcgtaaacagaactgtgttcgtctgcactatatataacattgccattccaatcagtcaggaagatcagcagggaatattccaacgcataatcttcaatcaagctatccaaaacatcgctatcctgctgttcggctatctgtaaagcgacctgctttatattgtgtattgccatgctattataaaaactttgcaggaatacagtttgcagcagccataaagccgcaaaaataattgctgcgaagccaacgaaataaagccacaattttacaccaaaagatttacgattcagcttcaaatttatatcccacccctcgcagcgttacaatccaacctctataggtccccagcttattccgcaatagtttaatctgccagtctacggtacgatcatcgccgtagtattcgtacccccatacagcgttcaaaatttgatttctggagagcgcaattcctttattctcaacaaaatacattaataagtcgtattccttggcagttagttccgtctttgtgccgtccacaaatacattccgtcctaacgtgtctattcgtaagcctgccagcacgatttcggcttgtgttcggtcttgtgatttgtgacgatttacaatgacgtttacccgtgccattaattctttaggagaaaacggcttaactacataatcgtccacacccacttcgaaaccaagtaacttgtcatactctgcaccgcgggctgacagcattagtatgggaatatctttttctttgtggatttctttacaagcagtgaatccgtccatatctggcatcatgacatccataataatgatatcaaaatgattgttatggcaaagtgtaatcgcctctaatccatcagaagctcctatcgcttcataaccatcatgctatgcaaatcttttaataagctggtaaatatcaggttcatcatctacaacaagaatttttatcatcgcagatacctccttttctgtactatttagcaaatattatatcagaaaatgggcatcttctcaatccgacagaatttgatatgcgacaacagaccggcgtggccaatgctgcaccggtctgttatgcttattggctatctggaaagatacccgttgattgcatcagcctgttcctgtgtaataactccgttattcagaagttcgctgaccgaatcgccatcaaaaccgtctgacttgaaactctcataaaaggtatgaagttcttccggtgtcatatcggacttgctggcatacttggcatgaagatcaacatgcttttgggcagcggcggttgtgattttatccgctgttgactggtcgataatgccagcctttacaagttcctcggcatctatatgctgtgccgtactgtaagggccatcgccaccgattccctgtgcctcaaaaaaggcctcccgatctgcgtctgacgtaaagcctgcggcttcttcaaactgtgcatgtcggccggcgttgttttgctgcccagtcaaatagccgtaggaagcagtgggttctgcggcgaatgccgttgtaccgacagaagccgcgatggtaagtactgttaatgctacggttgccatcctaagttttgttttcatattctttacctgctttcaaattattctgctctttgcagtgtctttattatgcaccctgacattggaaatactgtgcaattcattaggaatccatgtggaattattgattatgtattcttaaaatagtttttgaagaatatcaacacacttttcaatacccagtatcccgctatccagtgaaatatgatagttttgtgcatatccccacttcatatcggtataaaaccgatgatatgccgcacggcgtttgtctttttctttcaaccgatgttcaggggattccgctcgttcaccataaatttcgacaatacgcttggcgcggtagttcatatttgcatggatgaaaactgtcaggcagtctgccttttcccgcaaaatgtaatccgcacagcgtcctacaatcacacagggacctttttcggctaactccgaaatcactttttcctgaacctcccataagtagtcatcattggtctttccaaaagtacgcggcgtaagcgcaaaccccatgactgtcacttttgcgtcctcgctggtatcttttacatagctatctgcaaaaccgctttcctgtgcgatctgatgaatcaactcgctgttatagcagggaattcccaacatgtcagccacttcttttccaatcgtgcgcccaccgctgccgaattcccggctgatggtaatgattctgtttttcatattatttttcctccattcagttctttatagatgctgcgaatcagaattgcagccacaacaaatgttagtaaatccgacaacggcatggaatacaatacgccatccagtccaaagaaaagtgggagcaggagtgcaaagcctacgccaaacactacctcgcgcaccatagagagcaatgtggattccagcgccttgcccattgcctgcaaatagataaagcacgctttgttgatacaagcaaaaatcatcatgcagagataaatacgaaaggctctgacggcaaaatctgtgtaatatatactttcatttgcagcgccgaaaatagcaattaactggtgggggaaaaattccaccatagccagcgcaatagcgcccaccaatgcctccgccgtcaaaagtttggtgaacaattctttcacacgcagcttgtgtccggcgcccatgttaaatcccacgatgggaatgcagcctgccgccatacctaccacgatagaaatgacaatctgaaaaaatttcatgacaatgcccactaccgccattgggatctgtgcgtattgctcttgcccaaatacaacatccaatacgctgtatttgcgaatcatattattgatagccgccatagccgctacaaggctgatctgggatagaaagctggtaatgccaagcaccagcgtcctgccgcaaatgctgccgcatagcctgtaatcctttttttgcggcctgataattttcatattaagcagataccacacagcaagaatagcagtaacggcttgccctaatacggtggcaatcgctgcgcccatcatgccccagcggaatgtaaaaataaaaatggggtcaagaatgatgtttaagaccgccccagccagcgtggaaatcatagcgaatttagggttcccatccgcacgaatgatgggattcatggcttggccaaacatataaaaaggaattccgatggtgatataaaaaaagtatacctgtgaatgatgaaaggtttcggcattcactgtgccaccgaacatggcaataatgccgtcggcaaaaacgagatatagggcggtcagaatcaggctgattgcaacaaccataacaactgcgttgcccacgcttttcttggcatttgcagtttcgttcttgcctagctgaatgctgacaaacgcacagcagccatcgccaatcattacagcgagagccaaagcaacaaccgtcagcggaaacactacggtgtttgccgcattgccgtaggaacctaaataagctgcgtttgcaatgaatatctggtcaacgatgttataaagcgcacccacaagcagggagataatgcagggaaccgcatatttttgcattagcttgcctatgggttcgcacaccaagagctgatttgattctttatccattggaatcatcctcctctctaataatttcacgtttatctctggatatctcctgaaatcgcagtatttcatataggacagaaaagcgctgtgtggaaaggatcggcatcgggtgcctgaatcagagaaaatgggtacagcaaacaaagcgtcaatagaaaatgctttgtcggccaaaggtaacccatacatctcatggcagcaaacctctcacatctaacagggtcacgggagaccccggccctcaattccttcgttctgcctatccacaaaatgggtttcagtaatgctttcactccgagtcgttgctctaatggagggtgataatgactgactaccggctctcttgtctgtgtgaaactgttttagggggatatccgtaatctgtgacgctttcagaaaacatcccgtatggcgaaaatcaggctgctggcaggcatgccggacggtgaatgtccgttaccatctttaccgggtcgtaggtgctgccctttttaagcagggcgtagaacacccgaatcaatttgcagctaagggcgatgagcgactgcttcttttttagcgggttcttgttcctggtggtgtaatagcgatggatctccatgaactcttgatttttggaaaccagaggcatcacggcctgaaacaaaatcgcccggagccttgcccgccctcgtcggctgatggaggtttgccccttgttctgtccagagctattctcccgcagggctaatcctgccagcttttgcacctgctttggagactgaaagcgcctaatatctccaacctcagctacaaatcctgcgatcgtaacaagtcccacaccgttaatccccatcagtttgtcagcgttgggaacttgtgcaaccaatttttctacttcttccatgatctgcgcgtactgctccattttgatgcggtaatccgccagcagaaaccggagctccagtctggccccatttccgccactacatccaacgctgttttttgccgcttcattcaggctctcagcccttttcattccaacggcttttaccttggatttccgccacagttcattgagtccggtggcgcccagcgtgagaatatcttccggcagaggcgcgttctccagaacaatcaatccgcttactgtgtcaattttacagtacaccttcataaattccggaaagtagatcgaaagccaccgctgtatgcggttcttgatccggttcaattccttgcaaacccgccgccgacactccatcacgctccgaagatcggcgtacatcccttccgggatgtacggctcgttgtaccggccctcgcagaccagcttggcaatggtcttcgggtctttgcggtcagatttgctcggatggttatcatccatttccttgcttttcttcacatgatggggattcaccaaaatcaacttcatttcgctttccttcaggtatgacgccagattaaaccagtaatgaccggtcggctctgcgcctactatgacggccgattttgctgcgctgcgtttcagcttttccacccatttgtaaaaagcttcgaatccctccttgctgtttgcaaaccggaatactttcccaagctccacacctcgccagtcaaatgccctggcccactgcgtttcatgggcgatgtcgattccgatcaccagtgtgttttctgtcacttgatttagcttctcattttggctataattcatggtacagacctccgatggtttttgattggattttgctggccagctcatccttatcaaattctatcgcgaggtctcttcttttgcaaagcctgttttcctcgttctacaggaatgcttttacaaaaaaatagcgtgtaaacctgtgttggctggatttacgccgcagggctacacgcttgtcttatatttaattttttaccccaaataatcaccgaccgggctggaattgtattgcttgattactttaactatgatagaaccatccgactgttctgtctgctcaacgattttatactgggtatgcttgtgctccaaggatttctgatactgagcaacttcttcttttacttgttgcatagcatagtcatgaccaacatcctccttcagcataaaatgaagtgtctgacaaatgcaggcggcttttacccgtttcataccactgtccctccattcctaaaaaatataaaacgagtgacacacgcaactggatttacgcacgtgtgccactcgttatggatttattatactggatttcatacaaatttgcaaaggacatttttaacaaaaagtatatttaccttttaatttcgatgtcgcagacaatattttcacgccgccgtcaaggagcggctggaacacagaacggagattacaggaatttacgagattcataaaatttttgatagggatattgacaaacttcttgacttgccgtatcatataacggtgatatataacggcgttatatggaaggagatgatataatgagcgaagcggaccagacaactctacatctaattctttcagccgccatgcaggaatttcttgaaaaaggtttcaaatctgcgtccttgcggaatattgttaaaacggcgggtgtgacaacgggcgcgttctatggctactatgacagcaaggaagatttatttgaagcactggtaggtgaacattacagctttttgttggattgcttttgcaaggcgcaaagagaatttgcagaaattccaccagaggaacagccagacaatcttaccactacttccggcgagtgtatgtatgaaatgctcttgtacgcctatgatcatttgaatgaatttaagctcattctttgctgttccgagggaacgcgcttttcaaagttgattgacgaaatggttgaaatagaaacaaatgcaacacacgactatttcaaggtgcttgaaagattaggtagaccggttccctcgattgataaacggttagagcatatcttgattacaggaatgttcaacactttttttgaattgattatacatgaaatgccgattgaagaagcaaagcattatctaaaagaaatgagaactttttacaccgccggatggatgaaaattatggggcaataagccctataatttttacacacgagttagttaatgctaactatcaaattggatatttgcggtttatcataagcccttttatcatacacaaaaaaataaggaggtttttttcaatgaaaaaacagtctaacttatcacggttaatgggttatgccggagggcataagatattgacctatctttcatggatactgtcagtcatgagtgcgctgttggctcttgtgccattttggtatatatggcgtatcgttcacgacatactggaagtgtccccggacttctcacaggcggagaatgtcacaggatacggttggtctgccgtattgtttgcggtactctctattgtcatctatatcgcaggtctgatgtgttcccacataagcgcgtttcgagttgccgccaatatccgaaaaacgcttatgcgtcatattacagccctgcctcttggagtgacagaaaagtatggaagcgggaagctgcggcgcatcgtcaacagttccagcgctgctacggaaacgtatcttgcacacaggctgcccgacaaagcgggggcgattgcaacgcccattggactgctcgttttactgcttgcgtttgattggcggttagggcttttgagccttgttcccgttgtgcttggttttctcattatgatgaaaatgaccggaaaagacatggcgcagagaatggaacagtaccaaaactcactttctgatatgtcaaatgaagccgttgagtatgtaaggggtgtacccgtagtaaagactttcgggcagacaatcttttctttcaaacgcttcaaagacgcaatcgacaattacgaaaaatgggtgattacatacacaaagggactgcgtctgcccatgatgttttatacgactgcaatcaatggtgtgttcgcgtttttgattgccggggggattctttttacaaagagcggcgtaacgaatgaattgctgctgaaccttatcttctacattgtgattactcctgtcattggtacgacactcacaaaaattatgtttatgactgaggatgcaatgattgtagatgacgcattgaacaggatcgatgaggtgctgaatgaaaaaccgttatctgaaagtcaagtgaacaatgtgccgaatgacaatgggatcaccttggaacacatcagttacagttatgacgataagaaaaacgcattaaatgatgtgtcattacggatcgaaccggggcaggtggtagcgctggtaggcgcgtccggcggcggcaaaacaacccttgcgaatattgtgacaagattttttgatccgcaaaaaggacgcatactgatcggcaacatcgacttacgcgacattccgaaagaaacattgatgaataaggtatcttttgtatttcaaaatagccgccttatcaaagcatctattttggaaaacgtgcgtatggcaaaaccgaatgccacacgcgaagaaatcgcccatgctctggaagctgcacaatgcttggatattattgaaaaattaccgaatggcatggatacggttgtcggcacaagcggcgtgtacctgtccggcggcgaacagcaaagaatagcgattgcccgcgcgattttgaaaaatgcgcctatcttaattcttgatgaagcgacagcgtttgccgaccccgacaatgaggtacgcatacaacaggctttatccgctctctcaaagggaaaaacggttattatgattgcacacaggctgtcgtcaatcatagacgcggattgcatttatgtactgcaagacggtgagattgtcgaaagcggcacacatagcaagttgatagagaaaaacggaatatttacaaaaatgtggaggaattattccgaagcggcagaatggaaaattgcaaagggggtaaacgcatgattaagacattgcaaagacgctttgcgttatcaagacagggggctgtcgatttgataaaaggctgtattgcttgtgttgcacaggatatatcctttatgcttcctgttgggctgctctattactttgtcattgataccatgaaggggagcgtaaatggaagccgcattgctttctatggggttggcgctttagtctgccttgcccttatctttgttgtaacatggtttcagtataacgccacctatttagcgacttatgtggaaagcggggtaagacgcatttcgttagcggagcagctccgcaaaattcccttgtctttctttgggaaaaaagaccttgccgatttgacaaattccataatgggtgactgcgccactcttgaaacggcattttctcattatgtacccggtttggcaggttctcttatttcaacaacgctgattgcgatttgcttgtttgcttacgattggcgtatggctcttgcggctgtttgggtgctgcccattgcatttgcgatcacgtttttctcggcccgcatacaagaatatttcacccgaaaatccgtagcggcaaatgttgcgttggaaagcggtgtgcaggagtgcatcgaaagtttacaagacttaaaggcgaataacgcggaagaaaattatctcaaagggcttggcaaaaaaattgatgctgtggaaaaacggcacatcatttcggagtttgggactgccctctttgttgtttcctcgacgctggtattaaagtttggaattgccacggttgcccttgtgggttccgcgctgctcattcgcggggagattactattccgctgttctttatgtttttgcttgtggcttcaaggctgtatgccccgcttgagggtgcattgcaaaatcttgccgcggtaatttccaccaaaacgaacataaaccgcatgaacgaaatccttgaccagcctatccagacaggcagcaacgaggtaacaaataaaggctatgatattgtgttcgaccatgtaggatttgcttataataccggggaaaccgtattgaaagacgtgtcctttacggcaaaacagggagaagttaccgccttagtcggaccgtccggcggaggtaaaactacggtgtcacgccttgccgcgcggttttgggatataaataaaggcgaaattacggtcggcggtatggatatatcgaaaatagaaccggaaacattattgtcgctgtattctatcgtatttcaagacgtgacgctgtttaacaacacaatcatggagaatatcagaataggcagaaaggatgcgaccgacgaagaagtgattgcggcggcgaaactggcaaattgtgatgaatttgcggtaaagctcccggacggttacaacagtatgattggtgaaaacggctgcgagctgtctggcggtgaacggcagcgtatttcaatcgcccgcgcatttctcaaaaattcccctatcatcttacttgatgaagcaacggcaagccttgatgtggaaaacgaaacattgatacaagctgctttgtcaaggctgataaaggataagactgtacttgttatcgcacaccgtatgcgtaccgtaagcggcgcggataaggtagttgtactttcagacggttccgttgccgaaaagggaacgccggaggagctgatgaacacaggtaagatttatccccatatggtacaattgcaaatgataagtagagattggggcatttagaaagcacaatatatatttttaataaagtatacttacttttacgcttttctaaaccgttagattgagtcgttcaaggagtaaaaaacattcacaaattacgtctcctgacattcgctgtcacagcttgacaaaagcgcgcgtacctgttattctgaaaccacggcagaaaaggccccaccacaagaagtgaaacgaatagaagcaaagcctgacacacccgacgcaccatgcgtctggtctgtcaggctttttattttgccgggaagggaggtattcgactggatgctttacaacgggaatgaagcgtctgtcctgccgcttgcggcaggagactgaacgccaaaccgcaaggtttgaagttaaggcaggaataggggaatgtcattccccaccaaaacggcttgcaggcaaagcctgcaacggaaattagagcagtttcacggaacctttttagaacccttttgaatcacccggaaagaggtggaaaatgaaaccatttcagacgatccaattaaatgttaaagtgccggaacagaccgccgatgagattaaaaggctggccatctcccggcatcagaccgtggcggaactgctgcgccactttattgaagaagggctgaaaatccatagctacgagcagaacatcgactttatcgccggtatgatccggcaggagtttacatcggtctatcacatcgaggacattcgcgcggcggtcaatcagacattcgaggagcatatgccgaaaatcaacagaaatttgctgaaaagtggaaaggtgtccgccgccggatacttcctgctgattaaggtgttgatggaaatgggcggccttgacagccttgcggattttgtccgcatggcgaagcaggcgggaacactgggagccgaatacatgaagcagagcaacagcacgctgaacgagtttctcgcggacggcgaaaccgtctgccgtctggcgcatctgcaagcggacaactaaacagagaggaggaattgcatggacaaattcggccaatctgaaataatgctgcaaaagaagattgccgaaggaaacgaaaagaagcgtaaatttgaaatcggcggggcgacatattttgtaactgcccattataaggagcaaggcggtatgaccgccacggacaaggtcgcccgtttaatagatagagacacagagacggcgtagagagtcaaaaatgtctggacgcgcaaagcgattttgggtaaaataaggacatacaatttacccgaatcgttttggctgtacagaggaaaggagttttagaatggtacagcaaaacgaccggcgaaccgccggcggcaatatcacggctctctactgccgtttaagtcaagaggacgaatatgccggagagtccggcagcatccagcaccaaaagcaaattttaatggaatatgccaatgccaacggttttcccaacccacagtattttgtggacgacggttattccggagtcacgttcgaccgccccggctacaaagccatgatggagcaggtggaggcgggaaacgtgtctaccattatcgtaaaagaccattcccggctgggcagaaaccgccttgtggtgggtatcctgttggaagaaacctttgcaagctacaatgttcgttacatcgccatcaacgacaacgtggacacgctgaacggcgtggatgacagtgtggccgtccgcgatctttttaacgagtggcacgccagagacaccagcaagaaggtcaaggcggtcatcatggcggcggcgcggcgtggggaacgcatcggcacaaaggcgccttacggctatcgaaaagacccggatagccgtaagcagattattcccaacgaggacaccgcgcctgtggtgcggcggatttttgccctgtgcgccagcggacttggccctgacaaaattgcacggatactgagggctgaccaaatcctgacgcccactgtttatgaatttcgcaccaacggcgtccgccataccaatctgaatgagaataagccctatgattggtgtggctctaccgtggcggatattttggaacgggaggagtacatcggcaacaccatcaactgccgcagttacagtccatccttcaagagcaagaaaagcaagcggaatcccccggaaaagcagctccgctttgagcatacccacgagccgctgatcgacatggaaacatgggagattgtgcagaaggtacgggcgggtaaacgccgtcccaataaaatgggcgagatggatctgctgtccggtatggtctactgtgcggattgcggaaaacggcactacttctgccggtgcggaagctggaacgaaagccagtatacatatacctgcggcacttaccacggacataaagaggactgtaccccgcataccgtcaaggtcatggcactgcacgaaatcgtgctggcggaggttcagcgggttacgcaggaagcgcgggaacacaccgaggaattcctccgacgggcgatggacaagcacagcagccagctcaaaaaggaattgtccgccaaagtcaaagaattggacagggcgcagaaacggcttgcggatttggaaaagctgttccgcgccgcctttgaacagcttgcgttggcgaaccttttggaaacccagtttaaggcgctgacgggcggttacgaggaagaacagcaggagttgacaatccgcagtgaaatgctggaacaggaaatcaacgcggaaaaagaccggatgctgaatgcagaccgctttctcaaggtggtacagcggtacacggagattcaagaactgacgccggaaatcgtgcgggagttcattgagaaaattgtggtgcatgaaagaagcgagccgtggaaaaagaagaactacacccagcagattgatgtgtacttcaattttgtagggcaggtttaaaacagaaaagccacaggataccgaaatatcctgtggcaaatcttaaaattggtaaacatccttgtcaggcagagacgaaaccgccccagctttttcttacataaaatccttaactttttaaatatgggacaatgaacccacagaatgcagccaccacagaagcccttatggaccaaagctttagtgcaccgttaatacccactgccaactccccattaagtaagaacacgcttatcagctgtacgactacaatcgctccccccagcaacaggaatactgccagagacacattgaagaggaccgtaatacaggacgaaattttttccttcatttttcgtaacctccctctaatatattaccgggataatcccgaacatgaccagaaacgcaatcaaaatagccggtatggcaaagtgcagaatcaggtttttaaagatggtgacaggccgttccagccccgctatgccgctggctatgtaaaggggcgctgagttaggaggcatacatccttcattgcttaccagaatcaggattgcaacacaggccaccgccggggcaatgtctatgctgcgcaatgccatataagccactgaaccaactgcgctgatggtggctgtcgcggtaaaagggccgaccatcatggtaatgaggatagccacaatcactgccagcaggataggggaaacatcattcagggcgccaaaaatcgcggacacatcctgttcaagccccagtttaatcaacacacggctggatgcaaatgcaaaaaacagcagacatcccacttctttgtactttccaatggactttctgttaaactcccaccagcctttcatggttcccggaagatactttcttccttccagtatggcaatgatggtaatgaggatgggaatccacagaatcatggaaatgctgtccaccccgtcctcgccaaagcttggactgctggtgaggaagtccgctacgggtcccattgtcaggacaatgggaatcagcaccccgataaaaataagaagggccttccagttatgtttaagcgcttcgcccatactatggattgaattggcaggtatgggttctatggcgtacttcttaacatagaacctgactatcagaaggcggtaagccaggacaaaaaatcctgtgctgagcagcgccatgtacaattgcccatctgtcagctcggtagctatgaccggcatccccagaagaaggaacatggaagaggatggaggaaacacattgcagagccccgcattgccggcaacaatggacgttgccgcaccagtgtcccatcccgtctgcttcatccatggaatggtaatggaacctacggcggacgcggagcctgacccggaaccggatatcatcccgaacagggcgcttgctatgacggaaacgtagccggagccgccccgcagccttccaatcaggctgttaaggatagttaccatacgctcaatcacgcctgtcttgctcatgacatacgccatataaataaaagccatggaagcatacaccacctgctgcttggctgcaaaaccaatcccttctgcaaacaattcagccgggttgtttccgttcacaccccccagtaccagaagcaggataaaagatatcatcatggcctctgccatctttcgtttaaacaccacattgataatcatgatgctggcaatataaaccaccagcgcgattgttccaatccctaataagcccataatccttcctctccctcttaattatactataaccccggcttttttcagtttttcatccacatccggcttaatcagacagttattttcaatctcttccatccgtttagcctcatatgccagtttcttctctgtcccctctacaatctgcccaacaatgtccggacgtatgacaaccacgccgttatcatccgccacaatatagtctcccggcagcaccggtaccccgccacagctgatgggaaggttaatctcacccggaccgtccttatcccctacgcttggagtcacaaaacgggcaaagacagggaactgtttctcctgtaactccgcgatatcccggatgcctccatcaatcacaaatcccccaatcccttttttaaatgctgcggacgccattaaatcccccatgacgctgcagttctcacacccgcatgtatctaccacaatcacatccccctcttttgccaggccgattgctttgtgaagcatgaggttgtctcccggacgcatccttaccgtcaatgccggtcctgcaatacgtgtgccctttgccgcgggttttatatgtgcatccattgtattgaatttgttcagaccgtcgctgagcgccggagtcccataggaagtcagcttatccatcaaatctgaggacggccgttcaatgtcctccccgatgcagaatccgattttacctgtatatgtaaacttcataatcaatttatcctcttttctttactgatgagaaccgcttttaccagcggatatataaatagtaccacacataccaacaggatgggtgttgtgattggtgaggtgaatgcctccagcacattgccattggtcatcttgaccgcgcgccttaagttggattcgcacatattccccaggaccaggccaaggatgagcgctgccgcggaaaatccctgtctggaaagcatatagccgaagataccggcagcagccatgagtatgatatcacctgtactgttcttcaatgcataggagcctatagcggccagcatgatgatggccggcccaagaaaactgtatgggacagacagtatcctggcaaatattttcgcaacccatatggcaatgaccaccataagtatatttgtgacaatcatggatgagaatacactggccaggaaatccggctgggtccgcaccagtagcggccccatctgtaccccctggagcgccagggcggacatcatgattgccgccgcattgcctcccggtatgcccagggccagcagcggcaccatggaaccgcctgtagccgcattattggatgtctcagcagccgcaatcccgtccgcacatcctgtgccgaactgttccggatgtttggaaatcttcttttctgtggtatagcacaggaacgacgcaatcgttgctcccgctcccggcagtatccccaccagggttcccgcgacagatgagcgcaggataatccatttcatcctgaaaaattcgctgacagagggaatcctcgtctttacccccttgttattgtccaacccgtccatctccctgggtttcactgtctgcttaaccacctcggtgaccgcaaacatccctatcatgacaggaatcatctcaataccggataccagggtgtcattcccccatgtaaatcgtggtatacccagtaaaggatccataccgatgcaggccatccacaggccgatgagccccgatatcagggtcttaacaatattgccgctgtccaagcaggacagcaccgacagtcccaggaacgatacggcaaacagttcccccgggccaaacttcagcgcgaccgcggaaagctgaggcgccagcaggcccatggcaaaggccgagaacaaccctcccaaagccgaacataccagagaaatacccagggccctgcccgcttctccccgctgcgccatgggatagccgtcaaaggtggtaggcgcattagccggggtaccgggaatcttaaacaggattgcggtcactcccccacccgttatggatgaacagtacacggaggtgaggaacgcaatggcgatgaccggttccatcgcatatgaaaacggcagcgccagggcaaccgccatggacgcgctcactcccggcatggcgccgaatacaacgcccagaacagttccgcagaaaatcagcagaaaagtttccggcctcaggatgatctggaaaccattcattaatactcctgacattagttacctccttttccgctaaaaagcttcaatccataatgcaaagctgcgcagcaccccatatccccttggaagcatgatactcaggccctttgaaaatacaaaatataaaatcaccgtgatagccagtgatgccgcgaatatgatatgggcgcgccgctcccccagcaggaagcagtatgccgcgacaaaacaaaaggatgttagcagaaatcccgcatattccatcatcacagccattgccaccaccagcaggaaactgaccagaagcttgccgcggaccatatcccttaagacggcaagggaaatcttatcccctgccccagactgccgctgttccttccataaatggaacagatgtatcatcagaagtaccataagcaggcccagtatgatctgcggccactgctccccgcccagttccgtactgggtgagaccggcattgtggctccaatataaaaatagcaatatgtaaaaaataacagcatcagcaatgaaaacaaaaactgtatcgtcaagcccacacgctcctttccctggctataaatccgttaatccttcacactctccaccagctcagtaagcagactgaagtccttatcccaggtctccttaaattcagccctgttctggtatccaggcctctggtccagtccctgctcggtcatccactgtttgaattcctggctgtctgccgctttctttgcagcagcttcaaatgccgcaattgcttcttccggtgtccctttctttacgaatatgccgcggtaggggcccagataagcatcaatccccagttccttggtacaaggtacatccttatattccggcaccgtcattctctgttccgccgctgtcagaaggggtctcatgtcgcctgactgcacaagagccatacagtcggaaggccctgccactgccagatccagatggccgcctatgattgccgcgttcatctccggtccctcattataggcaatggtttccaccttatcaccgaatatctgctccacagtcagcccgtccagtcctgtgactgccataaccccgcattttacctttcccgggtttgcgtcaatatatgccatcagttcttcaaaggtctgataaggagaatccttacccgtgactattatattgatatcatggaccagcctggtcacaggctcaatgccaccgtagacatccagctccgtggagccgttaatctgtgccagaaggggggacggggtgcacaacaggaatgtatatccatccgccggctgcttcattgcaaattccactccggtcgtaccgccggcccctgacttgttattaatcacaataggtacatccagctccttctcaagttccgcggtgaaagcacgcagtgtgatatccgcagcacccccggcgccccatgggcatacgatttcaatcttcctttcaaactcccatcctgcggctgactccgcatcctgtgaatccacctgtcctgcctgtgcctggctctccttgctggccggcgtctcagcattcttagcctggcagcctgccagcgtcatcgccaatacaattcccccgcaaataatccccattgtcttccttttcattgcaagcctcctcgttttagatttttgaattgtaaatttctttactttccgtgaaataaaatatttattactttttattttttttagttataaatattttatataatttatatcatatatagacagatatgtcaatatcaattcactaaaatcatttcttttatgtattcataacaaaaaagcaccccgccacagcgatgtgctttttccagacaattcccctattttatttttgcatcatcagattcatcagatttaaataccgctcaagctccttcaggtttttcttcaccagctgaggattctttaccgtacaaagccctacgattatttcacacagataggaggccgccaccatggaattgtgaaaatcaacgctttcgcaatgtgtcagcaacagcacatccgcgtattgtgcaaggggcgaattatatccgtccgtgatgacaatcaccggacaccccttttccttcaatatgcgtgtaatctccacaacaatgcggttatatctggccatgctcatggaaatcaggacgtcatccctggtaacccgccttaatacctccactaattttcccatatccggctctatcaggtccgatttcccaaacatcctttcaagattgtaattaaggtgataggctatggaataacagctcctgctgccgcagatataaatatggccggcatctgcaatgaaccgttccattttatccaactgctcattggtaagcagactgtaggttttgtcaatattgctcacctgcattttggtaatctctgtcaccatctcatcaatatcatcccttatacagtcatcagacacattcagttccagcttattggacggtgacgccttggtctttaaatactcctgcagttccctttgaaactcagcatatccggaataccccagcgatgaagccagcctgaccaccgtggtggtactcaccccaatggcatgggccagctggtctaccgtggaaaacgccgcttgcatgggatccctcaatataaaatccgacaccttcttctgaagctttgtaaaattcactatctcttcttccaggcgtaccattatatccttatccatattaggacctaacctttctttctatttcattctatgtaacatatattttattattataaatgatataaaatgtataacatagaacaatgtagaaagcaagagcctgtttctgaaatgttggaaagggggctggcccatataacaggccaaagatttcaaaatcaaagatggtttcttttatatagccgatgagtacctgcaaaaactacagggttagcgccaggacgccgcacagcagacaataagccacgtagatctgggaaatcaataaatcgcctcgactccactggcgttctacacctagtttttcttcgttcttcgttttaaactcatgttgcaattcttcaccaaattatttccaaatactatgtgatttatcacttgagggacgtatactaattcctcagaaaccctgcaagcaggttttcttttgctgtaccattataccatatacactcctttaaattctcagcaagctccggtgtttgcttcagtgcaaaaattgccgcccaaaaacgtccgtaatcctcctccctccccttatcttcatagactcggaccaactctctgtccatgcagtttaaatcctcagactcaaatatttcgtccactttatcataaagctgttccaggatatcctgttccagcctatccgtatcaaaactcaacttaactttgaacatctttatgtcctcccttcctgatactatcaattccatttatttagcaatatcagccaccaatgcctggaaaacgatttccactttgatacagtattgcttctaatcccctcttgtttacagattcacatccaacatcatacctgtccttagctggatttaaagtttgtttttcaatatcacacgtatctcccggacgatctgccgtatgaagatattatcaaattcggctcctgaggccccgcctgtctcacctatgattcggctgatttcctggtccagatattcatactcgtcccttatcttttcctgctctcgtatgctttcactcctcctttttaattcgcttatctgtaatcccagctttcgcattcggtcgctgtaccagttctcaccaccatgttccctggctgccatgcccacataatccataagcaggtcacgcagttcctctatggttttatcaatctcttcctctgtacacgctcctccaacaatcttggcggcccgaaggatatcttcctttaacgtaggtgactcatgacaccgtttcgtcccatgctccagacggttgatgcagcgctatacgattaccttcttcccatttttgcccaggttgtcctgcggtaatgggctccgcattcattgcacaccatgattccggtcagcgcatatttagaactatatacgccctggtccgtcttccctttcctggttccggctttttttaacgcggagcgtctggcctgttacaaaagacgttcacggcagactatctgaccaaacagagggtgaagaactctggccagcagaagcagtactacgtgaagaatcatcatgaggcaatcatcccaaagacagtcaattacaacatctcccatgactttttcattggtcagtatgttgtagctggtacctgtactccatattttcttaccgatagtggtctctatccctgcatcctccagtctgtgcttgattcgttccaggctgtccccgttcaaaaacccccgggccatgtttcggataacagcgacttcctcctccacgatgcacatctctcccgttggcactttcctgaatccatagcttctctgtcttgtagattcccctttctcaaactttctcgcatacccccacttgacgttggtgctgatggcacggctctcctcctgtgcctggctgctcaggatgggtagtatcatttcggttgagtcatccagggagttaaggtttaccttctcaaagtacacggccacattcttatccttgaacttcctcacccaggagatgcagtccaccgtgttcctggcaaaccgagggattgatttggtcagtatgaggtctatccttcctttttcgcattcctccagcatccgttggaagtcctccctcccccatcggctggttccgcttattccctcgtccacataaattccgcagaattcccaggccggatttttctggataagtcctttataataccccatctgtgcgtcataggaatgatactggccatcgtcatccgtgctcacacggcatatgcacacacacgaatgctccgtatctgctatcctgtatgctctggtatgttctttgggatgcatattacttctgccacttgctgcgcctcctttcctccgttttcaacaaggcacattactgcattccctgcaccatatcaagtatcagttctccgaattctcacattttcatacaacatgttgggaacatatcctctggtacttccgaaggagcatatcatacatgacggatcaatcagcctttggcgcagcagctcatccagtatcttctgtactgctctgaatcgcaggtattgaagcagctccattgtttccatagttcctccgggaataccctatttccacctcaaggatttcctcatgtgtatcgctcctggagccgttatgggaatacccatctgtaacacgttcatccctcctggcctcgttccatcccacatccatgcagccatcccggaagaatggctgcatgatctggcatcgaaatcaccttctttctgtttcttatttgtgcttctatttgacactactccccgaagcttgtccagaaggatacctggacagggcagccagtccgcctgcctgcagcttacaggcatcataggaattccacctcctccgggttctccgggggccgccctcattgcgtggtccccgactaagggggctgtgactggacggaagtatcattgtcagctgtccggggccatggcgattcaaccctgcttatgattgattgagagtcaggtgtgtaccgctcttgccttaagatgtattgcacatccatggacaggaccatgtcctgcaggcagtcttcgcgcacccctcacgtcgctttcgttcctcacgaccggacagccaatgtaacagattggctggatatgaaattgtcaatgtacggcggacggcatactcccgtccttttattcaggcctgcatgaatcattttttcttttgtggattataatatatccggtctcccacttaagagatggaccggttataccccattctctccttccattccgggttttcaaaaaatacccctctactatttaaaagccgaaaaataggcccactgataaccaacaaatttaattttcaggattatacacaatgccctcctgaaaatccctatgaaaatacataatattttactgttgttgatgggcagatgttttcttccatcatgcgaattcttcagataacttcgttggagcaacctcccctgtactcatacattcccctctcatgaatggacaatttcaatgagttgtctgggatggacttatgtttttctttacacataaatggattaaccagtttctcatccccgtaccatccccttctaaagaaaatatccccctactactagtggtaaaaaataggccttctgataaccagatttcttcttacgattttcttaagatgcacaatttcggcatacaaccaggcttgccaattacatttccagataagattcccccgcgactcatggtaaaaaacagccctttgatagccaagattaattgcaaaaacttttcaagccaccttgaacactcttatcatctgccctttgaaaatatcggctgaaaaaaataccccctcactattagtccagtttcagcccccttttgataacctcaaaaattcattttcgttaaaagtgcacatataactttagttatttttactcagattatcacgcctcaaatgatttatattctttccctctgtactagatattccattgggtacttcttggcgggccaccatgggccagggcatggcccaccggatagacagactccacccttggagtagcatgtatttttttgtacgggtacagcacgtatttgatttttttcgcctcgtttttcctctctaaacaaacaaaaagccgccacataatatgacggctaccctcaaaacatactatcacatatcccgaatcattttcatcaaccgtatcccatccttcaccccttcctcatacagatacagctgacacatcccatttccatccagcatgtcatcaatgcaatcctctatggcatccctctgctccttggtaatttccttcatccaatggtccatccgttcgttcagctcgtggtctgctttcttttcttcctgtgtcttatcttcctgccatcgggttaccagccattctaccctggctgctattacttcctcacattgttccctcgtagttttcttcatggacactcctccttccgccaacaccatatcgaatatcccggcggaagtccatatccacatgtcataaagattctgctccaaatacgtcagaaccacctacagggtgcacctataaatacgccatttgccttgtacttgcgtagtttccagcaaaaaccgaccacctgacaggtgaccaaggctccaaacaagtgcacctttgtggaagcagaaaaacgcccgcattgcgggcgattgtggccgggaggggcgcctttaggtgcacctccctttaacctgcacacaaatcgaatgccggaatcacctctgaaatctgcatgctgatagtccatgatatccctgtctctgtacttgattttacgctgttttctcaaatccgcccaaattccgtggctttctcctaacatgcccagtactcccacccttccccgcaaaagcccacacgctgccttaccgtgcgtcacaagcctagtttatccggtaccctgtctggtcgtcctccaggtattcgctttcccattgcctgtaccatcccgaatcaaggtctacctatggaaagatgggccacatctcccctgtccccgtacgctgtcttacgtattctccgtgccccatgttcatccccttgtttccatcattcatcattcgcccgattgacagtgtttcaccgttcctggctcctcataccagtcctcccttcacttgattcccggctttcaatatattccctgatggatgtccggatgttctggaaggtggagtccaacatatgtctctgttcatgtgtcagatgcaaaggatagatagcctttcgcagtgaacactcccttatcactttttcggagtgtccgccctaccttttcttcatacagcatgtccagcacttcatcggatgcctcctgaatcacatccaataattctcccagcaggcataattcccaccagcatgttatcattcaggctgtctggttggaatacaaataagtccaggttatatcagatattgattaattccttcataacgattttatttccttcatcctgacgggttaatggcaccctcgtaagtgtcaagttgtgtttcatccatctggctcggcttataggccaataggttcacttcttctagtgtcttatccccgcatacttccaatacgttgtcgagaaactgaggccagccctcaaaccacttcagtacaatttccttctcggacggtgcctgtacacaccagagcgtctgcaatctctgccttgcctgttagaagttgtaggaccgcacttgtgtatccccgctatccgttgtattgatttgccatgattgttgactgtatttttgttttatacctccatcaaaaaagaaccaccatgtaggcagttcaccgcatatctcagttatccacatacactcggttcttcggagccgcactatattgggcatggttttattactccccctactaacctgtcgtttgaatttatgaaaaaccatagttacaatcacatttccaatcaaaagtcttcctcctactcctttcccctactggcacatctatatcatcatagtcaaactattctatatagccacaataatcaattacatctaaatgttttaatattcctacctggttaactgccaaaacagctccgctttcagttaaatgtaatgtttcaagcgtatcttcaagaagttgcctggttttgttttcaataactattacttctaaaattgttggttatcaccccgataaccaacaaaataaaataatttacatcccatctcataatccatccccatcaaagtaatctccaataaacgtagacaaaataacttccagaaaatagaaaatcccctggttcactacccaaaccaggggatgtcatctacacttatgcggtttttacccttaaattcacagccaaaaacaaatccaatttcaccaatttttcgttctaaaaccacaacatattgtgttcaaatatgtttttcttctccaaaaaccacaagtgttatctacatcacaactccaacctcatcaatcgccttaccaatatcatgcctcatatacttattcccaaattccacccactccgttgccttataagcattttctctggcttccttcagtgtatttccttttgctgtgacccccagcacccttccgccgttggtcactatattcccgtccttatcgaacctgcttccggcgtggaatacataatacccgtcctgtccgtcaaaccggtccaggccgtctatcttataacctttatcataatgctccgggtatccgtctgatgccagaaccacacatacggctgcattgtcctcaaattccagctctatctggtccagggttccgtccacgcaggcctcgaacacatccacaatatcattcttcatcctgggcagcactacctgggtctccggatctccaaacctggcattgtactccagcaccttggggccgctttccgtcagcatcagaccaaagaaaatgattcctttaaattccctgccctctgccttcatggcgtctacagttggctggtacacatactttctgcagaatgcatccacctcatccgtatagaatgggctgggtgaaaatgttcccattccccctgtgttcagtccctggtccccatccttagccctcttgtggtcctgagctgaagtcatgattttaattgtctttccatccacaaaggagagtacggatacctcccgtcctgtcatgaactcctcaatcacaatcctgtcgcctgcagagccaaactgtttatccagcatcagggtctttacgccttcctttgcctcctccctggtgctgcagataagaacgcccttccccagcgccagaccgtctgctttcagcacgataggcatgggagctgtctccaggtatgcaagggctgcctccggagaatcaaaggtctcataagcggcagaagggatgttgtacttcttcatcaaatccttggaaaatgccttggaagcttccagtatggcagcatttttcctggggccgaacacacggatgcccgcattttcaaatgcgtccacagcaccggctgccagcgggtcatccggtcctaccaccaccaaatcaatggcctgctctccggcaaatgcgaccagcttctcaaagtccatgacaccgatatcaacgcattcagccaccttggcaatgcccgcattgccgggagcacagtataacttctccaccttcgggctctgtgatatcttccatgcaattgcatgttcacgaccgccgccgcctactatcaatactttcatgacgttcctccttattctgaaaacatggcgcacatggcgtgcgctgctgtcaaagagatgttactgcccattggcaatcatgttgattgctttaggaaggattacccactctgcctgctccataacccttctttgcaggatttccggggtatccccttcctccacttccactgccttttggaggataatggggccggtatccatgcccccgtccacatagtggaccgtggctcctgtcaccttcacgcctctggccagggctgcctcatgaaccttaagcccatagtaacccacaccgcagaaagagggaatcagggatggatggatattgatgatacgccctttatacttctcagtcatggccgccggaatcatcaccaggaatccggccagtacaatcaaatccaaatcatattcatctattttggcaagaaatgcctggttgaacgcgtccctggtgggaaactgttttggagaaatgcagacagcccggatcccatggtttcttgctctctccagagcataggctcccggattattgctgatgaccacagatacctctgcattggtaatatcaccatgatccacggcgtccaaaatagcctgaagattggttccgcctccggataccagtacgcccactcttagcataaggatacacccttctctccttcttcaatggagcccactacataaggagcttcgcccgccgccttcatggcttccatggctttctccacatcagcaggattaacggccactatcatacccaatcccatattataggtattatacatcatctgctcttcaatctgccctttttcagccagcagcttgaataccggaggaatggggtagctgtcctttctgatgacagccttcacaccgtcttttaacatacgcggaatattttcatagaagccgccgccggtgatgtggctgcacgcctttacggtaacgcctgcttcctttacgtttctcagggccttcacataaatcctggtaggggcaatcaacgcctcgcccagggtagtccccagctcatcataatatgtattcaggccttcctttgtcagctccttctcaaacaccttgcgcaccagtgaaaaaccattgctgtgtacaccggaagaggccattccaatcagaacatctcctgcacacaggttttcgcctgtaatcaggtccttcttatcaacaatacccaccgagaatcctgccaggtcgtactcatcctccggataaaagcccggcatctccgctgtttccccgccaatcagggcagagccggactgcctgcatccctcagccacaccttttacaattgtagcgattttctccggaacattctttccgcaggcaatataatccaggaaaaacagaggctcaccgccagcgcaggccacgtcgttgacacacatagccacacagtcgattcccaccgtgtcatgcttatccatcaggaatgccagtttcagcttggttcccacaccgtcagtaccggacagcagagtaggctcctccatccctttgaacgcggacatggaaaatgctcctgaaaatccgcccagaccgcctaatacctcagggcgcatggttccctttacatattccttcatcagttccactgatttatagcctgcctcaatatcaactccggccttcttgtaatccatcatggtttctatcctctcttatctgctatttcatttgatttccctttaaaatttcctttgattttcctttaatatttagctggatatttcctttgcccgtttcctttaatctgtcttatttcatctgtgcaagatattccttatagcccacctgctccagcttctcagcctttttcaccacatcgttcttcaggctttcggaatactctttcagctttgcaagcagctccacatcagaagtggccagtatctttgccgccaggattccggcgttggcaccgccgttaatagccacggttgccaccgggataccgcttggcatctgcacgatggaatacagtgaatccacaccgcccaggtcagatgtcttcataggaattccaatgaccggcatagggaaaatagccgcgcacataccgggaagatgtgcagccttgcccgcacctgctatgataaccttaaagcccttatcctcagctgcctttgcccagtcaaagaatacatcaggctccctgtgtgcggaaataattgtcatctcataatcaatgcccagcttgtccagaatctcagctgcctttgccataacaggcatatcagagtcgcttcccattacaattcctacttttgccattgttcattctccttttctaaagctcattatccttgtagataattattattagtttttcttataagtatctttatatagctcaattctacttataatcataatactaggaaatgcgtatgccgtcaatataaaacttgaaaaaagtcttctgcattttaaattgtttttgtaatgtatctgcctaaaactgcctggttccagcatctatcagccaagctatcatttccgacgcaggactgtgaacaaaatacgcaggggaatgccggtatggagcccatatgggtccgccgtacattcccctgcaaaatccttcaagtttctttccggtatcctattgcctgctgataaattccaagcattatctcaattcccgaaatataaaatttatcattacgttttccctggcatcagtaatcatacttctctgcggctctcctcagtattatcacacattgcacctcaacatttcaccctatcatccgtaacttccattgcacgctgccgtcttagccgggcattaaaaatctcaatcatccatcagtcatcgtagtcattgccgtcgtggtcatcatcgtgccggtcatcgtaatcatcatcgtgatcgtcatcgtggtcgtcatcatcgaaacggtcatcatcgtcaaaccgatcatcatcatcaaatcgatcatcatcatcaaatcgatcatcatcgtcaaaacgatcatcatcgtcaaaacgatcatcatcgtcaaaacgatcatcgtcaaaacgatcatcgtcaaatcggtcatcatcccaggctcccgcatcattgtcccagtccacatccgcaatcctgcctgtagcggcgtttacatccacctcaagtttccttccatttaccagaaacctcaattcataaacaccgtcgtccagttcacatcccttgtaggtcagttcattttccttcagccccaattcctttatggcgatccgcttcgcctcattcttccctatatataactgttctgactgtttcccgttatccttaagtgttatggtgatatcaatgccgtttttgtttaccgcttcccatgcagcctcttctatctctttcatgaagtcggccctgggataaacagatcctttttcagactcaatgaccagctctttctcatttttgtctctgcggaaccatcccttatcatccatacgcttaaccagtctgcgtacagctgtatcacagtccgcaccggcaaaattccctgccccctctaataatttccgtccgtcctgattcagtccttttgcctccaggacctctccttccttgtcataggaaagggatatcttcggacctgcgctgaggaacacacgtccccatgtttcttcctgaatccttgtttccctgttggagggcgcacccagtgccgtgctgcccacgccaggcagggaaagggccatgaaacctgcacacaccaatatagctgcctttttaatcctctttgccgtcataattattttcctcctgtctgctgtgatttatttatctacatccgtagaatacgtgaggcaaaatgtaaaaccggggtcgcggacaaaaaattttattttatttcccttctcattgctgctgccaaaatattgacaaatgcagttggctgtgatatagttgccgcattgtaatgaaggagaggcagttatgggcttttatatattaaatcaacctcggaagaaagagagctctgtacaattcataccgatgaaacattgtacagagtatggcgtatcttatgcgctttcgtgatttcatcgggaaactgagtaatggaccggaggcagcagtgtaggctgccgcctgtttgattgctcttttttcccgtggttatccgtgcataaaaggctatggacaatgttttgtccatggccttttgtaatgtgaggaaatcgtatgattttgtaatacggcagaaggcaggtgcaaatttggcatctaccttctgcctttttttgtccggttacaaacaatacggtttcctcccatacagctttcacctcccatgcagctttcactgcctatccatacattgcaatacagcgcagtaccattaaatataaaaggagtgtttcaattatgagtttattagacataacaggactttcccattcttatggggacagccgcctttacagtgattccgatctttcccttaaccgcggggaacatatggggattgtgggtcagaacggaaccggcaaaagtacgcttatcaaaatatgcacggaacaggtcatccctgattcaggccgcgtggcctggcagccgggcattaccattggttatctggaccagtatgcctgtaccaatcacgttttgaccatggagcagtttttaaaatcatcctttcgcagcctatatgagcttgaagccaaaataaatcgtctttatgacgaggccgcattatcctgcaatatggaggtcctgaatcaggcatcactttttcaggatcagttggaacgcagcggtttctactccattgatacccttatttcccaggtggtttccggtctgggactggtctcaatcggtttgtcccgtcctcttaaggacatgagtcaaggccagagagccaaggtcatcctggccaagcttctcttggaaaaaccggacgtccttctcctggatgaaccaactaatttccttgacaaggaacatgtggaatggctgggcggttatctttcagcgattgaaaatgcctttatggttgtctcacatgaccgcacatttctggatcggatatgcacacgtatctgcgatatagacaacggcaggctgtccaagtattacggcagctatacggagtttctgaaaaagaaggcatttctgcgcgaggaccatatacggcagtacaatgcgcaacaaaaagaaatcaaaaaaacagaagatttcatacggaagaacatagccggccggaaagcccagatggcccgcggacggcagaagcaactggaccgtatggataagctggaggccctggaacaaaaggaaatcaaaccggaattctgtttccaatgccttcccttgaccaaatgcctgcatttgtccgtaaagcgtttgtctgtggggtatgattatcccattttgtcccatctggatttttccgtaaccggaggacagaaggtggttgtcactggttttaatggcatcgggaaatccaccctgctgaaaacattgacgggaagcctgaatcccctggatggggtcttcgctttttcacagcaggttacaatcggatatttcggacaggatttcagttgggaaaatgatacattgactcctgtccaaatcgtctccaatgcctacccgaagctcatgcttaagaagatacgccagcatctcacccgatgcggggttctaagccggcaggccgtgcagcccatgggcacattaagcggcggcgagcaggcaaaggtcaaattatgccttctgacgcttagtccctgcaactttttgattttggatgaacccactaaccacctggatatccaggccaaggattcactgcaggctgctcttaagagctttcccggaaccatactgttggtttcccatgaggaatccttttaccgcagctgggcaaaccgcataatacacattggggattactcttctccataaatacgctgcggcttttgctttgccgcaggtaataacataaagacggaaccacatggagtatatccctacccatctggttccgtcctgcttttggtcataccgtagtcatttggcggtatttccgcccggcggcatctcttctattttcttacgttatataacacgctgcatgaccagcacatgatatcagtcatcatcgtcatcatcttcgtccttatcatcatcgtcatcatcttcgtctccatcctcatgcccgtcgttatcctcttcttgggaatcgttttcgtcgatatcgtcttcatcagagtctccttcatcggaatcgtcctggtcagaatgctccccgccgtcatctccgtcccggtctctgttatcatttaatccatttccggccttcccatgatctctttcatccgaatcatccgtatccttatcatcgtctgcaccgctgctttgtctcaccacattgtttctgccggatttatccctggcttttttgatatcatcgtctctgtcatccgtatcgtctttgtcgtcatcgtccctgtcgtcatccttatcaccagctttatctttaccggcgttttcctccctgtcatcgccatcatcttcatcatacttatcgcggtcagcatcattttcttcatcatcattttcagtgtcatccccacgctcatcctcgtccctgtcatcttcaccattgccgtccgcatcttcccccgttcctcccggaggcatcccgatgaatgccggcttatcccctcctgttcctccgggtatttcacccttatgatggggggcggctgcgggggggctgtcctttcctatgctttccacatgtacttccaccggcataccatcctttaaaagggtgtccagccctgtgcgtatggcatcggcccgttttgccttccagcgctcgctcccgccggatgccgccacatatacggtccctccttcagtcagataacccatttccatggcccgttccaccagtatacctgtcatatattctgagtcccttcccttatatgacacctggtcaatgagtttttttccgtcctcattcacaccctccaggccaactacgcgatccatataactcacagacattttcacatccggattgattctcacctccactgtaccatacggcattccgtatgcgccataggccccgcctcccaatacagccaggcacaggcaggcagctgcggccagcggagcaagacggaacaggatgggagcctttggtgtctgccgggcaattatctctcctaccacctgtccctcctggtaacccagattggcagcctttatcattctgccttcattgtcaaggacaatggcatatgacggatggcactccattacaagataagtcatacggttccctcctttcccggcgatatctgacacagatgtccccggataatttcatatccgttggtataagccagcaaaatggcaaccagatacgtccggtgccgttccatggtctttctggatacgccggacagctctgacagctccgcaatgggtagtttgcggctctgtatcaggtgttccagcagcctgggatggctcctggcagcctccagcactttgtgacatgccttgagggtacggtcctgccgggggcagttatccgccacatcagacagactgatgccatactcagtcagattccttcggaactcatccaactcttccctggtagccgttctcacattccacagctggattccgtttttctcatcaggcattacttccaatagggcgtgggaatcatcctcctgtcctgccggggcatcaaaggaaaccaatccctgatggcgcccctctttcctgatgtagtctatgagccggttgcgtatggacgcggcagcataaggcagaaatgcccctcttccccgctcatacccctggaccgcctcataaaaggcaaacatggccacactaagctggtcctccctgacctgtgttggaactccctgggtaaagcggactgtctctgcctgtatgaaattcatatactggccaatcaggctgtcagcagcttccggactcttctttgcctcatagaccaaacggactatctggtgctcttcccccaagatatcacctccatttaccatagaatacgcaggaaccatttctgtttcggggtcacaggaaaattgttttctttttatttttattttcctttttatttccttttatctagtataacagaaaaaatcacttgttccatccatgaattggattgtacaagtgattttatcatatctgcttatgtggaaccccgtaagactaattttgcagagagcatctcattgtgaggaatattattgtcttccaaaagaccggctgttgcgtctacacaaattctgcacaaatcttctaagcggttatcaatagaagataattcaggctcacagtattccgttatatacgaattattaaatcctattacccttaatttttcaggcacgggaattgacatccgtttgctgaacttgaccacaccagcagccagattatcatctgccgtaaccaccgcgtcaaatttcaatcctgatttataaatagcttcaatgaaatctgctatatcgtgcacatttgtaatttcattgggacagtatacactgtatccgtcccagtctttatcatatgtcctggcagcttcatgaaaaccggccagtttacggataccgctgtaagacttctggttatagacaaacagcacgttttccgatcctgtccgatacagccactgcgtggcttcgtatatagcttttctgtcatcgcaggcaacgctgtaaatatttgggtatgacatactggcatttatcagcatcacaggaatcttgtccgctgcatcccgaatgtactggttcaggaaatcatcacaatccacaaagcctgaacctaccagtataactgcatccacattttttgtcagcaaaaattccagtctctttttcttattctccagttcatatccggtacagcacaaaaccgtactgtaatttttatccctgagaaaatcctccagataatggatggccagggctaaaaatggtgccttacagtctgctgccataataccaatcatgctcatggacttgagtgacagacctcttgctaatgcgcttggctggtagccatgcctttcaattacctccatgactgctgccctggttttttcacttacctttgcgttgccgtttaaaactcgtgaaaccgttgctgtagaaacatttgcctcttttgaaatatcatatatattcattttattttgctcccgctattcgggcattcgactcctcaatttctttgtctacattactctggtcaatgtaggacacaccggcactgataaatgtagggaaattcctgtctcccaaaaggttattatgctcaatgtataatcccaggcatgcccaccagcccatattataacagccctgcgctatggaccccattaccttcccctgttttacaagctctaactgcgccggattcctgtcaaaaccaaacacaacgatatctgacctgcccacctggtcacatccctgggatgccccaactgcctgtattcccaaagaacagaacaccgcgtctacatctggatttgctgttaatgccgccgctgtcttggatgcctgatccgcaatctccgctgttacacttacctcggaaatgacttcaatatcaggatatttctctgccagggtctctttaaatccctgtacgcgaagttcgctgttattctgcccagcacgggtcaggaccagaaccttgccggttccgttaagggcttcgcccagacgttctgcgccaaacgctcctgcctcatagttttcaacgcctacattgcatatccttttgctggcaggtgagtcaggtcctgtggtgatgaccggaatccccccatccatagccttattgatgacatccacatatgcatccgcattaaacacatggactgcaattccatccggctccatggatatagctctctcaactgtgttaatatattctgtcaggtcattctgggatgatcctacatgtgctgtctttacacctaacattttaccacaatcttcaaagccttcatagaccataagcataaaatcatcagtagattcataggaacaccaaagataggtctgttcttccggatgttccacgctgcctaaagccgcacctgccatcccctcaggtgatacagactcagacccagccgcggtctgactgcttcccgtttctgccggtttctgaccgctgcatcccgccgcactcatacataccataactgctgccatgacaacactgactatttttttcatatagacctccaatttttcatttgcgtattcttaaaaccagtttccactaattgcgttttgcctgcttgctaagggtatcgaatacaataacaacaatgagaagggcgctgcttgcaaaatcctgccagtaaactgaaactcccatctgtatcagcgcatttgtaaacagatgtatcatgattagtccaagcatggaaccaataatgtttccctcacctcctgccatactggttcctccgatgactgccgctgtgattgcccttccttctgcctgcaggcccagtgtgggagtagaaaccccgaatctggaggtagaaagaacacctgccactgcggccagtaacgctgaaattacatataaggctatttttgtattcttaaccttaatgcctgccagctctgcggccttggcattacttccaataaaatatacttttgcaaaaaactttgttttcatcaaaaggaactgacatatgattgctgcaataataagaagaatgaagaacacaggaatcttaccaatatatccggaacccagtttacggaacaacgcaacactttcccctgttatcggtatggaattcccggatgatataacataacacaaacctcttgccactccttgcattccaagagtgatgatgaacgggagtatgttcagttttgctaccaatactccggtcacccagcctaaaagcatgctggtcaacagtgcaatgagcattgccatccatacattcattccataataaatgtaaaactgccctataaacatggatgccagacactggaccgcacctaccgacaaatcaatctggccggaaataagtatgaaggtcatggccagcgcaatgaaaccgtccgcacagagtccgatggcaacgctcatcatattattcaaggtaaggaatgtctgggtcgtggctcccatgactatcatgattataaagataactcccaatacaagtacttctcgttttttaaataaactcttatttatcttcattagccaatctcctatcacaccttatttgtgcctgtagcatattggatgatgttgtgctcctcaatctcttcatcggtaaggactccccgcacttccccatccttcatcattacaatccggtcacacaaccccatgatttccggcatctccgaagaaacaatgatgatgccaattccctgctctgccaaagcccttacctttttatgaatttccgcctttgcgtttacgtcaattcccctggtgggttcgtccagaataaggacttttggatttacccgcatacatctggcaaccagcaccttctgctggttacctccgctgagggagctgataggcgcgtctatactgctggtcttaacattatgtacctttacagcctctttggcctttacatcctcgtctgactgcttcagccaaaaacctctttgtttacacatattcgaaacatagatatttttacagacagatagacttgggaaaatacctgttttctttctatcctctgtaagatatgatattccgtactttaatgcatcctggtaggatctgatggttattttctgtccctccaaccatacatctccggaaaaccttggatcaattccgcacatagctcgtaacatttcacttcttccggctcctatcagaccatagaatcccaatatctctttctttcgcaggtcaaaagaaatgggaattgatttgttagtcatcctcagattctcaacccgcatgagttctccgtctatcccgctgctcttatctggataataagctgatatttcccgacccaccatattattgacaatctgttccattgtcacctgattcttttcaaacgtcgctatcatatgaccgtcacgcaaaaccgaaacagaatcacatatctgaaaaatctcactcattttatgcgtgatatatatgatgctgattcccctggacttcagttcattgataattttaaaaagcattttcacctcgccctctgataaagaggacgttggctcatcaaaaataatcagcttagccttctgagatatagcccggacaatttcaatcatctgctggcttccgatagacaaatcccccaccttagtctcaggctctacagtcaacgagaaattctttaaaagggctttcgcatcttcattcagctttttcttatctatcattttatattttgtcataggtagccggtccgcaaatatattatacgccacggaaagatgcgtaaacatgctcaattcctgatgcacaaacccaataccagccttaaccgcatctgtggggatatggaaatcaaccttttccccgtcaatataaatggcacctttccctgaatccctctccagtacgcctcctattatattcattaaggtggatttacctgcaccgttttcacctactagagcacgtacctcaccagacatgacagataacgatacatctaccagcgcttttgtgccggggaaggttttggagatatgttcgacctttagtctttcaacctgattctccacgcttttgcacccctctctaaaaagtcctcacattgttttgcagggttccatcattgtaacaatcagattcccccattgatccactatggccttctggtccggataaatcaagatggtggtatctgtctgttccactatggccggtccgattatcacctgggaagcagccagattttcccggttatacacatcgctttccatccaccccttacattcatcaaaataggtccttctcttgtcccccggtactccccattccccttccctgactttttccattctgggtgtgggaacaggcttctgggaaatcagaatacgtatagctgtgaattctatctgcagattgcgaaaggcatgtttatacacatgttcatgtctctgatggaaccgttccttcacggcttccatggctgccttatccagtacgccttctgcctccgggaaaggaatctccaattcatatgactgccccacataccgcatctccgcagaataagtggttctcagcaaattttctgatatgccgacattggccctttcctgtccgcagagctgctttccctctccaatagctgctttcagctcctgcaagtccacttcatcaatcttggcagcaaaggtgaccacctcttcatgttctatatcagccgacagcaatcccaacgcagccataactcctggggtaggaggaacaataacctccttgaagttcagcagctttaagagactgcaggccgcaataggccctgccccgcctgatgccaccactgaaaaactgcgtgggtcatatcctctctttactgtagccagacggacctgatccgccatctggttatgcatgattttatggatagcggaagccgcatcataaattcccatatccaacacatcggcaaccttttcctgtatagctttacgggccagttccgcatctaatgcaacctctcccccggcaaaataatccggcctcaggtatcccatgattaaactggcatccgtataagtgggctctgttcccccctttccataacatgccggtcctgggaaggaacctgcactatgaggtcccactctaagccatccgcctccgtctacccatgcgatgctgccccctccggcaccaatggtactaatatccatcatagcctgcctgcagggataattgccgatttttccatctgtaaacagctttgtttccccattctgaatcagtgatacatcattactggttccgcccaaatccaatgtaagtatattcttcctcccggtttcctgagcaatctgttttgcgccaattacaccggctgccggtccggacagcaaggtaagaaccggacgctccgagcacatggaagagctggtaactccgccccttgactgcattaactgcaatgagttctttacgccgatttcagccaaagaggtattcaactttgtgatataccggtccatgaccgggccgatatacgcatcaaaggcagtaaccaccatacgctcatattccctgaatctgggattgatctttgatgaaaccgagacacggagtcccggatatctcttcaagatgatatccctggttctctcctcattttctttgttaaaaaacgaaaacagataacaaattgctatggattccaccttctgctctttgacaaggaagtcaactgcccttattacatcctcctcatttagcggctcaatgatatcaccttttgcatcaacccgctcccttacttcttttatccgttcccgtgggcaaagaaaactgggggtttccgaatcaaagtgtacgttatacagttcgtttcgggtgccgcgcccgataatcaatacgtccctgaatccttttgtagtcagaatgcctatcttggcaccctttttttccaggattgcattggtggctacggttgtcccatgaaccagtctttttatttcctccggctttcccccgcaaacctccagaattttatccaatccattgaaaaacccttttgaaaattctcccggcgttgaaggtacttttgtcaccttcagttctcctgtatcttcattcaaagcaacgatatccgtaaatgttcctccaatatcaattccaatgagaacactcattccttttctcccttcacttttactcttttccaagaattcccctatcataggtccaggtaataggcccgcgcttcagccgcaaatcatcccgagtcacaattgtcactgcatcatccactgtatttgtctttctgtctatagataccccatatacctgctctgccgtctcataggacactcgttcatccaggacatcctggagaaccagttccggtgcccgctccaacgggtctccatatcctcctcccccggcactttcatatccaatctcatcccctgcatataacatataatccccttttgagggaatctgtatgatgtccccattctttctctttatataaccggtgcctacctttgccgctcctcctccaaataacccccacggaggtacgaaaaatccatctccgcggaaagtaaaagatacctctccgtccagaagccgtattaccttgcaggaaccaagacctcctctgtatttacctgcacctccggaattatctgccaatccatacttgagtacccttaaaggacctgacatttcaaatgcttccacaggaatagcaagcacattctgactgtcactggaaattgcatcaatcccatcctttcccggtctggcacccaagccgcacatgccgttatcattggaaacaaaggatttctgggtagccggattatatccccctatatagagaagaggggcatatgcacctgaacaagcgtttaccatttcaggctttgccttggccagagcacccaggcatgtgctagacagcagctgtacagtcaggcctctggatccggtaggcgcaggcttaacggcatttactatgcttccttccggcaatatagactgaatcatcctgaagcacccgtcatttgtagggatagaatcacccccggtcactacctttactgcatattcaatggtactcagcgtacttgcttttacacagttaatgggacctttagtctgaggactgctgcctgtaaaatcaaacaatatatcagaacccttgattgtaacactcagcttaagggtaatctgtttatcaaattccacaccatcgttatctatatatccggtaaaggtatatgttccattaggaatttcctccaatgcctgccttgtcaatgcctcagagtgatccaaaagcccctccactgtatccagaaacacatctttaccatactcgtcacaaagagtctgtatacggtcaattcccactttgccgcaggccacctgtgcttccagatctcccatgacttcgtcgggaattcggacattctgtttaataatttcatggatatccttgacaggttttccttcatcataaaattttaccggtggcagacacaatccttcctgatatacacaggttgctgcggtggagacgccgggagcaataccgcctgtatccgccagatgaaccatactggcagcaaacgcaaccacttccccctcgtaaaaaattggtgtcaatgcagttacatccggaatatgtgaccctccgttaaatggatcgttctgaagatatacatccccttcctttgcctgtgaaaccggaaaatccttaagaatagccggtactgacgaggaaagaaatcctaattggcacggcatagccgctgattgtgcgatggttcgtccctttgcatcaaatatggctgtagacgcatccttcatttctttgacaataacagagaaagccatctttaataaggaatcttccatttcgtttgcaatggactgaaggcggttattaatgacttccataacaataggatctgatttcttcatctatttctcctcctggttagtattggtgaaaccgcttacactttcttttgaaaccgcttacacttgaattatagcatatgggtaaaacatgtcaatctaggggggcttaatttttattcatatatttatttttataccttttgctgtattttcctacgtatcatatgtgaataattgctatattatcagtcttcaaagcaaactatatggtaattattttttacctaatgacagttcaaaatttttcatcattagacagaccactccatcaaaaaaagcctgtacaggagaacttctacaattcccaagtacagactctgatactatgtatctaaatctcaattcatctattccgtaatctactcctatcccgcttcactgcacctgaaccgaatcctgctccggatctggagtaaagcaaaaatccttttctttgatatgatgttcaaaccagatgtaaaacacctctttcccaggctcagccacaagggaatgatcaaatcctgctggtatatagctccaatcaccagacttatgttctatggcaggcgcatcctccacagtcagcaggaagtccgaatttcccacacaataattccattgggccactctgggatgtcccttttctactgttccgccaccaacccctcttacaactcccaacatgattcttcccaactgtcctgcactcaatatccaccatgatgtggtgtcaggacctttacaatcctggtcataaatcaccgcatcactgataagtgtaaaaaaaggcagtctggtatgacattcagcatacagttctttgtcccactgattcatcttgatgacactgtacacgaattccatattttcgaatgcatggatgacatacggctggcgttggaaatccggtacataaaatgcaatctcggttattttattcagacagtcctttgtttttatatatcccctgccttttccgaacataagaacaaccatatcctccccatatatccggggtgatatctcacttccggctctgagataacatttatagttgcatacacctcccctatatgttccgggcaacaactcctccatatagaatccgttggcatcatattttacagcaatgtctttctccttagctgcataaaccttctgcatatttcatacctctctttctacggatctggttttacaataaaatccttctctctggcaaagtgttcaaaccagatatagtacacctcttttccatcttccgccacaagagagtggtcctgccctgcaggtataaaactccagtctccggaatacaaatgcgtggtttcatctcccactgtgaatttaaaatcagatttacccaaacagtaattccactgatgtactgcgggatgacctttttccacggtaccatccccatttgcccttacaacacctgccattatccggcccaattgccttccaagaagcacattccaggacgttaccccaggtcccttgcagctctgaacatacatggtacatttactgatgggcctgaaaaacggtagtcttgcatgggattccctgtacacttcccaatcccactgattcatatccacaacagccattacaaactccatatcatcaactgcatgtacagtatagggaacatggtcaaaatccggcgcataaaaaacaacctcttctatatgatacgcattcctctcatccgtaatgtaaccctttccaaaaccaaataaaagtaaaacaatcttatccttatataactctggacagtgtgaataccccgctttaaggctgcaccggtaaaaatgtattcctttttgataggatccaggcaaaagttcactaatcaaaaatccctggctatcataaatcagattctgttttttcctgtccaagtataatgccatgaatacctcccatctcaatcatacagttctcctctttctttgcaaaccgttaaccactgtttcgattgtatgaattcctcgatttccctgttccaattctcgattgcctccggatacaaacagccatatccctttggagcaattcggtagcacatacgttcaagaggaggattctccagttcataaagtctcatctgcgcatcttccatcagacgtattcccatagagtggggaacaattccccaacaatcatgattcttcatgaagctaaacgccaatggcggcgaattggtctttatgtacgggagttcctttggattaaaccaatgctcataccaaagcctgattccctgctccttccagtcaaactggcatgcgtcccgaatatcaagttgtcccggccgtaccgttgttcccgcaaattccatgtcagacgaagccgccaatatcatacgctctttaaaaaagcgccttgttgatacgtttttattctgctgaggggccaccacatatcccacatcaatcgttccatgctgcgccatctcatacagcttctcatctgtgcttagaacaaagtacattttaaccttgttattacgtttaaccatgctgttgtagaattcatccaaaaggtatattcccatgctttccacacatcccacagtaatggagggatgacaagatatttccttaaatgattttatatcataccgcacatctttcagtcgttctgccaatggaagaaatgcctcgccttcttttgtaagcctgctctggttctgtcctctccccctttcgatcagcttgcagtcaagctcatcctctagcattttcaggcggtaactcaccgcggattgggatataaagagattttttgccgctcctgatatgcttctagtacgtgcaatttctaaaaatacttcaatattctctaaatccattgcccctcccatcccgtttattgtagatagtctccatgaattataacgaattcctctatacaatgtcaattcatgtgcaaatttttctatactactttgttaaatatctaaaaattcattattaaaaccaccaaaagatagcaaaaggagacaccctcccccacaaccggagcagtgtctccctcatccatcatcgaatcataccgttattcacaatctaacccggctgcgccgtcatccgcttcatccagagcctcatttaactcctctgtgccttccaacacaaacctgccctgacggataatatcaatcaggcttccatctgccctgacagcctttatatcccctaattccgagtagggaatggtgatatccgtatgacagctgaaatatgccttggacatatctgtctttctgagaagggatatctcattgtccctggcaatgacctccctgccgtcagggttatacatgggcgaatcctcagcaaagctgtagcaagtatcacccactgcaaaatgaggccccatcttttcggcaataaggataggcagcttatcgccaatggaaaaccttctggccacggcataggccgtagtattggtaccgatggcgaactcgcccaaaggcagccagtcatggtttcgcataatgacctgcttcacaagggcctggccctgtctgcgggcgtccccggccgccccggcgtccttatcatttccggctgccccggcgtccttatcatttccaacagcctcagcgctcttatcatttccagcagctccggcctcccccatgtcctcaaaattcccgcaggaatactccgtcaccttaccatccttaaacaccatgcgcagattcctgaactgataatcctccacataaacattctttacgtgcagcagtccttctgtccccttcaatatgggggatgtaaaaacctctcccaagggaatgttcacatcggacacacagttctcgaaattagtctcctttttcctgtcccttaaggggtggagagccaccttcatggatgtctcattgccgtcacggcctgttatgagcacgtagccggcctcatccagtgcctggatgatacactgctgtattttctgatacttctcataatccagggtattgatccggatggtttcactgaaaacagcctcgaaatccggcccaatctctggtttaggaaaggcaatgatggtgaagctggtctcgtctcccggcatatattgatttacaatctgcctggattcattggcataagccagggtcagcgcctcctgatgggcgttgagggccagggccgactttttattctcaggggcaaagccttcctcaccaaatgtctccaccagggcaggacccgcgcaccaggcggcttccttccggtaggtctcataggcggaccgcagaacggccagcttcctctccttaaaagcattgcccatataaagggcgctgtcataacgatggtcataatcgtactgcttgttgggagatgtgccgtaatatcccctgcgtccgttcgccctgcggttcacggactccaccgctgccctgtaacagatgggttcaagtcccatctcccggaagtactccaccgccctgcggatcatccgctcaaagcccagctggaattccaccacaacggtccgttttttcttcaggtccctgcccatgacctggaaccccttcctgaatccttccgtataagtggatgccatctggtcaatggtctcctggggaagactgttcatgaaagaggcaagctttatctctgtctccgaaacatattccccgtaggcatagagataccgcaaatcagtcaaatcccgcttcatcacgatatctgttccaaaggaaagggccggatccagtccctcccgaatccgccagtccacggtgacctccgcatagtcgctgacaaaccagtacagggaatccttaatcagctgctccagaggcgcattttttccctcctcccatgcctgggcaaaaaggttatacacttccaggaacagctcattcagtatggtgatattcataagccgcatctcaaaggcatatacaatatcagcccggatttccgtatagagaaaggataaaagctggccgtagccatcccccaaaacctccaccgcgtaatccggattggcaaagctctccctgtaattttcaggcagaatatccttgtacagggcgtaattttcctcctgcagcgcctccagggtcaaagaagtcccctccagcccttcctccccgtttaaaccggtttcttccacccgctttgccagtcgctctatcccgcggataaaagccgaaaccttcttaaaataacagccgtaaggcagccccatctcctctgtatccatggacctgatacgctccatggacaattcgtagcgctcccttacggcatcattctcttcctgtaataagattctgtaatccatctgcatttactcccatctatcttacaataccggttatgataatcacagcccacacgatgaccagcaccacgcagatactgattcctattttcgccagtatgtaattgcggtccttttccataaatgagcgcacaccgtaccacagccccataagggctgcaacaaggctggaaaagccgtaagcccctgtattcaggcctccctggcccgcccttgtcacagacagacacatgctggccgtgcctaaagccagtcccagcactgccagggtcagacaatagtagctgtttctcgcaaaaggatttctaacatacgataccttatcgccaatctgcctcaacgggaaagcctcctttttctcaatttgcaccgggtccattgtaccaggcggtaacacagataacctgcggctgcccccagggtgttgagcagcatatcatccacatcaaagcttcccaccttgaacaccagctgcagagtctctaacatcaggctgaaaacaaagccgaacataaccgtgttgtaccactttttactgcgtctgctgataatggggagaaagaacccaaaaggcatgaaggccgccacatttcctatcatgttaatcatgaacaatgtgggtcccaacacgtcataataccggaaataccgcgtaatttccttaaagggcaccagattgtactggtaccccctgtctgtgtctgtgcgcccgaaggattctgaaaaaaacatgaaatacgccaggaaacaaagatacagtatgaataatacccatcccagcttttgacgctttgttgtatttcttatcattgtcagccccgcttactaaaattcaatttcggattttcgtttcagcagcagcgctccattaacaatggaaatgattccaaccgtaaggccggtcactgctatgatgactcctattgctatgcagccagcccctgtgttacgcatggttttatacactctctccatattcatcgcctttcttcctggaaacatcattatgcctgggctccatactgctcatagtaagcgtcaatggctgcctttatctgatcgtcgatgactaccttgccatttatttctttattatagaggtgctccaccacatctgccatggaaacgatggcggcagtggggaaaccgtataaatctttaatctcatccagagcgctcctggtgcctttgccgcgctccatacggtttaaagaaaccatgagtcccttaatttccacatctccctgggccttgatgatggggaatgtctcctcgatggacttgccggaagtggtcacatcctcgatgataactaccttgtccccgtccttgataggactgcccaaaaggatgcctgtatcgccgtggtccttgacctccttgcggttggagcagtaacggatgtcttttccgtacagctcgctgattgccatggtggttgccacgcttaaaggaatccccttataagccggcccaaagagcacatcaaaatccagtccgaaattgtcatggatagcctttgcgtagtactctcctaattttctcagctgggttcctgtgacatagcttcccgcattcatgaaaaacggggacttacgtccgctctttaatgtgaagtcgccaaatttaagcacactgctttccaccataaaatctataaattcctgcttatagttttccatcttccttaaacctcctgtatttacgggccgtttaaccgctctgtaattcttttgctgctgccttttttaaactgcctttgtcactgtctttatcattgtctttaatcactgccttttatcactgccttaccctgccggtgctacctcacagcccctataaggtcccggatatctccgataccatacgtttccatatatgcccggattccatccacagtctccaccgtggcataggggttatggaaattggccgtgccgatggcaacagccgtggcgcctgccagtatgaactccagggcgtcatctgcattcctgattcctcccatgccgatgatgggaaccttcactgcctgggcagcctggtataccatgcgcacagccaccggcttcacagcaggaccggacagtcctcctgtcctgttggccagcgcgaacgcccttttgtgaatgtcaatcttcatgcctgtaagggtattgattaatgaaatggcatctgccccgccagcctctgccgccctggccataacagtgatatccgtcacgttggggctcagcttcatgatgatgggctgccttgcatgtgcctttacctccctggtaatggcctccactgcctttgggtcctgaccgaaggcgattccgccttcttttacattgggacaggatatattaatttccagcatatccaccggctggtccccaagacgctccaccacatcaatatattcctccgtggtctttccgcagacattgaccacgattttcgtgtcatactgttttaaaaagggaatatccctctttgtgaacacatcaatacccggattctgaaggccgatggcattgagcatgccgccgtatacctccgctatcctgggagtggggttgcccggccacggtacacttgccacacccttggtaaccactgcgcccagacggtttaaatccacaaactcactgtattccatgccggaaccaaatgtgcccgacgcttccattaccggattcttaaattccacaccggcaatatttacactcatattcatctaaacggtacctcgctatctttcacctatacatgcctacagctcaatctcttccgccctaaacacaggaccgtccttgcatatacgcttattgtgtacctgtgaatggtcatccacctctttggaccggcacacgcaggccagacaggcgcctactccgcaggccatcttctcttccagggaaagccagcactccagccccttttcggccgcatatgccttcagtgcccggagcatgggagtgggaccgcaggcgtaaatgacatccgccgtaaggccctgctcgcggatagcgtccagcacatttccgctggttccgaagctgccgtcctccgtggctgcgtataccggaccgtatgcctcaaattcatcctttaagaacatctggctgtctctgtatcccaacacggactggaccagattgtcctcttcgtccttgttaagctcatgaagagcttttgccagttccagcataggtggaacaccgatgcctccgcctatcagaaatgccttttttcctgcctccaggggaaacccgttgcccagaggtcccaggacatcaatggtatcgcctgccgtgagcccggagaactccttcgtgccttcccccgcaatgcggtacaccagcctcagctctcccttttccttatcaatgccgcacaaactgatgggacgcggaagaatcctggccccgtcttttgaataaagggatacaaactggcccggaactgctgactccgctatctcaggcgcttttattctcatatcgtatatatcggcagccagctgctcctggagcgtgacggctgctgttatttttacttttgccataacatgaatctcctgtctcttacagtacgctgctgatatcagcaaccatgtcaatcactgcctgtctggatgcctcgccgaagtgctccggcccgaagttcttatacttttcctgtttgtaagccgcaatgattcctctggaggagttaaccacagcgccaagcccgtcctggttaaaacaatgcttcaggtcagcggctgttcctccctgtgccccgtatccgggtaccaggaaataggtgtggggcatgagctttctcagaatctcgctcatctcaggataggtggcgcctacaacagcgcccacattgctgtactcaccgtccatacagccggcaccccactcctccactttggcggccacccactcatagaggggctttccgtcaatcaggcggtcctggaattcgccgctggacggattggaggtcttgaccagaacgaaaagacccttgtcctcactcctgcatacatccacaaagggcttcacgccgtctgttcccagatatgggtttacagtaagtatatccacattgaatccgcttaaggatttgcttcccacctgcaccctgccaagatggcctgctgcataggcagcggatgtggagccgatatcgcctctcttggcgtcgccaataacaatcagtcccttttcatggcagtagtccacagtcttcttatatacggtcagtccttcgatgccgaactgctcatacatggcaatctgcggctttacagccggaatcaggtcaaatgtatggtcaatgatttccttattaaactgccagatggcatcggcagccccctccagtgtctctccgtaagcatccagggatttctttaccacatgttccggcacataggacagcatgggatccagtcctacgcagattggggcattggttttctttattttttcaattaactggcttatcataatgttctcctttgttacgagtttttcactttgcatgaattctttccccattttatcatataaagtaccttgtttcaaggaatgatattccagtattgcaattattttaacggacccgtaaacgaaaaaaaacgccggacagggaaaaccgatgagatatcagttcctgtccggcggcaaatcccaactcaattcctatactcctgtcatacactcctccctgaaacgaaatccccatccgtccccttccctgggactggcaaatccgttttctatctccatggcattatctatgatgccgtcaatccagtcaaaggactctgctccataaggactcctgaccgtgcacagcagcgggacatcgtaatccttataataatggggcaggaccggcaatccgaaggcctcagccagggcagcggattccctccacgcctccacccctcccagccggacgatgtccggctgccataaatccagggcgttgcgcgctgtcagctgttttaaagcctcaaaatcatattcccgctcccccatggccagcgcaataccgcactggtttctcaaaagctggtatccggcatagtccgtgtggaccaccggctcctcaaaccactgtattcccatggaggaagccctgcgggccagctccagcgcatccggcacattgaatccctgattggcgtccatcatgattttcacactgtcccccagcgcctccctgcactttgccagacgttccgcatcacgttcgatgcttcccgaaccaaccttgattttaacggccctaaaacctctctttttataatccagcacttcctccagcagttcctggtccgtgtaggaaatccagccgccgctgccgtatacaggtatccttctccggttggcccccagcatcttccacaccggctggcggcatgtatgcccccaggcatcccacatggccaggttcacggcagcaatggcgcagttgttgattcccgtattgccaaagtattccgcctcccggtcccagtcagccctggccagcaccgtatcatatacagcgtactctcccgcgctgataaagctgcagacatccctgagcgctccctccattgctcccggagaatagtggaaggacagcacatacccctggccccttacaccctccgccgtcatcagctccacaatataaaagccgatttggctgattgtgtgtgtggaatccgcaatgggtctgctgatatcagacacagccctgtaaaaatgtatatcctttatcttttcttttatattcattttacctgcagtcatgttctcaccatccaaagtattcttttacattcctgtagcatattccttctattatttccttcagatatttctcgtcggagaaatattctccgcgctccaccagttctcccagatagctgcagagacagcggcggtaaagctcatggcgcggataacttaagaaactcctggaatccgtcagcattccaacggacaggctcaggggatacagattccctgctccgccaaactggcgcatgatgccaaagggctggtcgttgaaccaccagggagcgcccagctgtaccttcccccttaccgtgccgtcgcagaagcctgctgccagaacggcaaagggttccatctgcgcagggtttaagggatacagaattgtctttggaagctgatcaagctctgtcagccggttcaggatacgtcccacggattttacggacgtggagtcatccacacagtcaaaacctgtggactgcccgatttcctgcaccttcctgtgattggcgtccagataggtaccgatatgaagctgcatcacaaaatgatattttttatagagctttgccatttcaatcaggaacgcggatttatacctgtttatttccacctctgataactgctccccagccgcagccttttgaaaaatgtcctccgcctgggcctcggtgtattcctcccacgcaatgtgggcaatgccgttgtcgctgaccgttgttccaaattccgcaaaaaatgccagacgttgttccagcgctcccatcatggaggaaaaatccacgatttcctgccccgctgcctgggaaaggattttcatataatccggaaatgtcttccgctcgcagtaaaatgccctgtcaggcctgaaggccgtgagaatgcgcgtctttaaaactgcattctcctttattttcatgtgatattccaggctgtccgccggatcctccgtggtgctgagcagttccactccggactgttccagacaccacccgggcgtcatgtgaagctccctgatccgctggttggtgcgccggtaaatatcctccgcattatccggcccaaggggttcctctatgtcaaagtaccgattcagctccagggcgcaccatatataaaggggattgcccgcaagatagggcataatctgagcaaatttcagaaatttttcatagtagctttttgttccggtgatatactcctcgctgattccgaatgtgcgcatggccctccatttataatggtcatgagccagccacatttcacccaaatccttgaactccctgttttcacagatttccctggcctccagatggcagtggtaatccacaatgggaagcctctccccatagctgtggtacagccggcttcccgtggggtttgtgagaagaaactcctcggaaaaacaatcagaacccaatcagagcacctccatccaccggcaggcaggtgcctgatatgtatccggccgcgtcactgcttaaaaatacggcagccatacctatatccgtcacgcttcccaccttctgcatgggaatccgtcccaggattttccccaaacggacctggtccccgtccgtggccttatggaacatgggcgtatcaatccatcccggcgcaatggcgttgacgcgcaccccgtaaggaccgccttctgctgccaaggtatgcaccaggcccagataacctgccttggccgtggcatagcctgccacctgcggctggccgatgtagctggtcatgctggcctggaacaggatacttcccttcccctgctccttcatgtgggggaacagtgcctttgtcagcgcaaaagcgcccaccaggtgtacgttcagcacgtttacgtaatcctccaccgtcatgtcctcaatgtatttcttgcaatggtttcccgcattgttcaccaggatggtcaccggcccctgctccgctatgacccggtccgccatctcctgggtatggtctgtgtccgttatgtcaaactgataaaacactgcctttcccccaaactcctttaaggcttcccgcccctgttcccggctctcatagctaagcaccgccacctttgcgcctgcccccaccatgcacctggtgattgcaagccccagtccggtggtgccgcctgtaacaattgcggtctgcccctctaatgaaaaataacttcctgtatcaaacattgcctatgcctccctgcattttttcgttgcgtccctgtcctgatatttatacggtataaaatactctttgtggcccagcgcctcgcttttgctctttgtgccggaagccacctctgccgccattttgagaagcttttgtgccatctcatcctgagagcagcgcccctccagcaccggcccggcgtcaaagtccatatcctcctccatggccctgtaggtagctgagtttcccgtgattttaatacagggaaccacggcggatcccaccacatttcccctgcctgttaccagaaatacaatatggctgtggcatgcagccaaatccatcagcccctcgctgtcattgggattggtgattccaaactgcatccagtatggatccggcgtggaatccaacagccacagaccgggatgaggcggcttaacccccaccttaagaactccctcaatgggtctgcttccgctttttatgagggctcccatgcttttttcttcaatggtggacagccctcctgcaaaattacccgggctgaccgagtactggcgcacggatttgcagtactccagggccttatcatatgtatccccaatctcctgcctggccctttcatttgcagcgcgccccaccagcatctccttaaggcctatggcctccacgatttcctcaaaaatggccgttcctcccaaatcggtcagccggtcgaaaaaccgtcccaccaccacatttccggccagcccgctggtgtaatcagaccccccgcactctgcccctatgattaaatcccggattcccatgggttttcgtttggtgtccttaagccgttcccgcatcagacccacaacagccaggcccttctctatggtctttctggttccgccctcctgctgaatgaacatccaggctgcttcctttccctctttcccggctatgtccgccagccattccggctgcacatactcgcaccccagcccaactgtcagcacagcgcccacattgggatggcgtatcagggcaatcagaaggcgcaccgcatattcattatccgtacagcccgaaaatccgaccacctctgtctccgggtcccctgcaagtcttacgatttccctggccacaaaggaagcgcactccacggtgtagatgaccagcaccttattgcgtattcccattgcgccgttcttcctcacatagcccatccagctatattcccttttaaggttatccatcgcctgcctcctactcatatctggtatccttgggcgctccggtcatcgcatccaggtggctggagcgctcatcgtacacgctgcggatattgtgaagatggacccattccccggcccttatgtcctttgatgccctggcaatgcgcaccccgtattttatgacatcctccccggctcttatgttttgaagagcgattttatggccttttggtatcttctgaacagcctcggcttccgtcctgcatccatcgcccagaagccttagcgcaccggggatgagctcctccagggcagtggccacattgtctttttgttcaatctgaaatgccctttgtattatttccattgttccatccatccggcccctcgtccctcctctacaaaataccgaatttcgcaaatgcatccgtggcgctcataccgtcctcgatggccttcctcaccgtcttttccccggcagcctttttaagggcctttataagtacctcatccgctgcttccctgggaatgaccagcactccgtccacatcaccgaaaatcaaatccccgtcatgaatccttacctggcctatctcaatgtcacacctaaaatccaccacctgggtgcggacgctggaatcctgggcataacagccgcaggaaaataccggccagttctgggacagcacctggggcgtatccctgtgccacccgttcaccacggcgccggacgccttcctggttctggccgttgcagtcagaagctccccccagtaggcgcaccgtttggttccgcccgcagcaatgtatatctcattttccttcagctggtccagcgcctccgtcagtagcccaaagggctttttctgcggtccgtacacatctgtcatcagcacggtcatggcctttcccgccagcttcatatcctcgcgcaggggccggatatcctggggcagaaactggtgataatatcccagttcgtccagtatgtcgcccaccacgggtgtatagagcttctccctcatcagggcgaatttttcattttcatcattccacaatttcatgacattacctcctctgctaataaccgaagcttaaagccccgccgtccacggcgaaatcctgtccggttatatactctgattcatctgacaccaggaactttaccatggcgccgatatccctgggattaccgaaacagtgcaccggcattctggccagtattttctgttttctctcttcgtccatgaccttgcggctcatctccgagggaaaccatccgggtgcaaccgagtttacattgataccgtcctgggcccattccaccgccagcccccttgtcatggacagcactgctcccttgctggtacagtagggcaccacctccgaaaaccccagatgggctgccatggaagtgatgttcacgattctgcccctgttgggagactgtcttaaataggggtagcacaaggtgcacagcttaaacacactgcttacgtttacctggagcaccttctcaaaatctgcgtccgaaacatcctgcgccaggctctttaccgtgattcccgcgttgtttaccagaaaatcaatgccgtgttcacggccgattctctctgttagttcccccatctccttataatcgcttacatccgccgccagatgaatcacattttcatggctggtctccccttccagcttcggcctgccgctccggctgacagcatacaccactgcccctgcctcagccagaacattggccgcggcaaatccaagtccgctggaaccgcctgtaataattcccgtcttacccgccaattccatcattccaacacctccatctgatgggaaacacaatttcgttcaatcagctcccagtccagttctccgccgattcccggcttgtcaggaactgtaattatccctttctcatcaatgggaagaagtcccttcatggggaacatgaaatcctcttccggcacaaaatactcaaaatatctgcaattgcgtatggcgcaggaaacgtgaaggtttaccaggtccatgtaattcatggtcgtggtatgaatctcgcactgcattccgaagctttctgccaggtgggctattttcaaagtccccgtaaccccgcatttccatgacacatcggccctgacaatatccgccgccttctggttgatgacctgcgccaccccccagtgacatcccctggtagtctccgtggcggcaatgggaatatccagggcggcacacagctgggtatatttgttcagttcaaaatcccggaagggttcctccagccattcataccccagcttctccaggtgccttcccaccctgacagcttcttccagtgtatattccgccacagggtcgctcatgagcttcatatccggtcccactgccttgcgtatattctcgtggatttccatatccagctcccagggaccggagggatgggctttataacagttgattcccctggatttgtaatagagggcctcccgcacatactcctgcgggtcctcatggaacagcccgctggcatatacaggcagagactggcggtaggcgcctatgtattgatagagcggaagtcctgctgccttggcgcagatatcccacagagccacatccaccgggcccggcagatatacaggaaaaaaggtcaggtgcctgtcaatgttccacagctcatgccatattttttccctgtcataaggggatgcacccagaaccaccggagcaatattatcgtgcagatagctttccgtcacccggcctgaccgcgctgccagggctgttgcgattccctggtatccgttatccgtagtcagcttaagcaccaccacatcccaatccatactgctcttgcccttgcgtttttcatcaaacaggcacttatttcgtttaacccaccaggtttcaaattttacgattttcataagctgtctcctatcctttcactgctcctgccatgattcccttgataaaatatttctgcatggacaaaaagattgccagcacaggaatcagggacaggataatggttgctgtcagggtaccgtactgccacgaagcagcctcatcccgcaggaaggtgatgcctacagcaagggtctgggattttgccgtggtgcacagggttctggcgtatgtaaactctccccacactgagataaatgtcatgatgatgaccgtggcgattccaggcttcacgatgggcagcatcacacggctgaaggtctgccactggcctgccccgtcaattctggccgcttccatcatctcgttgggaacgccgttaaactgtcctctcatgatgaatacggacatgggcaggttggttgcaatgtacggaagtatgaggccaagcctggtatcaatcagatcaaaacgcgactgcataatgtaaatcggtatcaggtatataacatagggcagggtgatgattagcagaacaaatccaaggaacaggtcccttccccaatactgaaacttggaaaaggagtatcccagggtggctgcgaaaagcacgttaaacagcacgctccaaaaggataccacaacggaattggtgaaatatttaaagaagttgcccagttttgtaaaaatacccgtatagtggcccagatagggatttacaggaagaaaggtaaggactgaggaatatatctcttcatccggctttagcgaggtgagcatcgtccatatgaagggaataatgaaaataaaggatatgacgaacagcaatataaacacggctatgctgccggcgtttttcttaatactcatgccctgttcctcctttttccggtctttttccgtttcacttcatcctcatcctttgtcctgttgatgtaaagattgatacatgacaagattaggataaccgcccccataaaataaccgatggcagacgcatagcccatctcgtaatatttaaacgcgttcatccatgtgtactggtatagaaccagggtggatgtgcccggcccgccgtttgtcatgacgaagggctgttcaaacaccttcacggactggataatggcccacaggccgcagattacatagctttccttcagattaggcagaataatcctgaaaatcctctggaatgcattggccccgtcaatcttggcggattcgatgatatccgacgggattcctgcaaggcctgccataaagaaaatcacaagcattcccatatttttccataagctgacaattacgatggaaaacatggcccattttccttctcccagccagttgtgggcccaagcgtccaggtgcagcatttccctgagcacgctgttgagaaggccatactggttgtttaaaatccactggaaaataatgccggtcagggaaagcggcaccaccatggatacaaatacgcaggtgcgaaagattcccgatcccctgacgcccttgtctaaaagcatggcgattatcagggaaataatcatgatggacgggaaaaacagcagtgaaaataccacggtatttctcagggaatccataaagtatgcatcggaaaacatctttgcaaagttggaaagacctgcgaataccggcttcttgtcaaaggcaaaattgtaattggtaaagctcaggtaaagcgagcgtatcagcggataccccatgtaaacagccacaaatataacccccggagctgcaaaggcatagccgggtatcatctttttcagctgcacgcccacactttttttattccccatattccacctcatcctatttctatgatgctggcaggaaaaccggccaatgtaaagactgtcattgaaccggccctgccggctggttttatttgttcatacctgtactcaggtcaatggtggtcatgaacttactcatattggctgaaaactcatcaaccgtggaagcgcctgagagcatcttctgaagctctatctgcatgttggtatccagctttgtgtagtccttgtacagaggaggcgtcgttgctttttctgtaaagtcaaggacagttggccaatatggattatccagtttctcgtaatgggccttcatgggtgacatcttgccgtaggaattcatggaatcagtctggaactgttcctgcaaaagcttatccttgatgaacttaatggccagctcctggttttcagatgccttgggaataacggcgccatgtatgtaggaaacagaaccatgggtgtctgtgcccggtatgggcataacgcctacattctctgcccccagaagctccccagcctcaatccatctggatgccggggcaatgtgcatggctacccttccggccttgaaattcgtcctgtttgcatcggcatccgcgaatacatccgtggtggtatagccgtcctttactaaatcctgccatacctggagcatgtttttgacgggaccggccgtgaagttcagcgtattcccgtctgactcgtacaagtttccgttggcccccatgacgcatgcgtcgtaggcctttaccgccatgttgtttccccagtcaaccgccagtccggtctgtccgtcctttgtcaggttctttgcatattcatacatctcattccagtctgccggggcagtgatagtctggtcctctgccacgtagccggcctcctgcatcatcggtatatttaccacgcatcccaagacttctcccagcagcggaatcatgtactgtaccccgtcagcatttccgctttccagaaatgacccgatgaacttatccttggtaaaatccccgttaaagaagttctcgtccgtaaactccaccacataatcattggcagcgtacggaaccgtctcagatcggtcgccgcccaaggctaaatcgcagtttgtctttccctgggaccactccagcatgctggaggtcacgtccacattgtccacctggttatagactacttttacacccggattctcttcctcaaattcctttgcaatcctctcaaaatcatatttccccatcatccacgcctgaacagtcacccgcagggtctgccctcccccggcctcctttgtcccgctgtctgaagcttcagctgccccagtccccgggtcagttgaggaagaaccgcacccccacagtacggatgatgccatgacggctgccagtgccaacgaatacgccttttttgtcttcataataaacctcctgatacattttagtgaaacgtttcccttaccatgttttcatcttactatattattctgccggtgtcaagatgcggaggttgattttattgttattttgcataatattttaatgtttttttgctattttatcattttattaacatataattaacatgtttttatattatcttttccgccgtcccgtttatcctcttcgcatctctaagaagcaacgtttcccttattccgcaaaaaacgacaaaaaaggggatggggcaaaaccagattggtcacctgattttgccccatccccttttttgatttagatgcaggaaatccatttaaataaaccgccccatcaaaacccgggacggcggataggttcattcaatttgagacagataatcactaaaaattttataatgcagtttttcgtctaatgataaccttgcaagcattttagaaacatgagggtctttgatttcttttgattgggccgcgtatgcctgagccgcaaactgttctgagcgggcattatcagacaatattgcagggatttcacagctgtaacttaccatattcccgcaccaataggaattgggcctggatgaacggcattcgggctggcctccaagaaggtgaatgagctgtccgattatggaaaagtggtgctgttcaacgacggctatgcgttgaatgacacggcgtatgttttgatgatgatcattgatggtccaggattgatacagatactggtgtaccgtggtcatttcgctggcggttgaggctaaatccgccataaggatctgggcgtattgctggttcttttccagaacagccacgggaggataccaatttgagtgtgcaaccggaaaagaatccgggtttgcgcggatattatattgaatattgttcatgggacattctcctgggaaaagctggataggtggttttttaatctttatgagaaagaatccgtctgtagaacaccattgaataaattaaatcatttataatttagctttttatgccgatatatcgtatataccttgtgtgctggtttggtatactcacacagggcgggggataaataccggcaaacttgtccagccatggttcaggccggtaatttgttcccatggttctgctaaaaatgacgtaaaagggggaaatatgcaaactatttttatagtcaaccatgctgttgagtgggagggtataatcagcgatgaatggctgagaccggaaggagcaacagagcagccgtacaaacagatgatttgcagaatgcatagactgccatggcaccagtcaccgggtcatgattactaaggagagtcgatttatgaattttatgaagaatttaaaaattggtaaaaaattaattgttacgtttggagttatcattatactttttttaatttcacttatggtatcaattgtaagtttaaataattccggtaaaaatttcaaggagttctatacggtgggttatccggtttccaacaagaccacggatatgcgccgtgctacccagacaggcttaaagtgtatagcgctcagcatgcttacggatgatactgcagtaacaaagaactatattacccaggccaatgaacaatttaatacattgtctccggccttcgactatttacggcagaatttcagaggtgataaggcggtgcttgaccaggccctgaacattctggaacaggcaaagccataccggatagagattcttgacctggcaggacagaataagaatacagaagcggctgatcttctttttactaaataccagccattaatgcaggaatttatgaatttaatgagcgaagttgattctggtaccactgcgatcgcggccgaggactattctcagtccgccaaggcccagacctctgccctggtatttctgatcaccatagctgcattggctctggcactgacggtcacacttgccatttatatcacaaaagccctcaccaagccaatcagcgagattgaggaagcggctaaaaagatgtccgcaggagatcttgaggtgtcgatcagctacgtttcagaggatgaactgggcagcctctccgagagcatgaggaccctgacccataattttaaggggattatacaggatatgggaatggggctgtcggctctgggtaatggggatttcagtgtggattctaaggccaaagagctttatgtaggcgaatttgcacagctggcaacatccatgtatcagatcattgacaagctttcatctgtattgggacagattaaccagtctgcggaccaggtggcatccggcagtgaccaggttgcgtccggttcccaggccctttcccagggagccacggaacaggcctcctcagtggaggagctggccgccacgatcaatgaaatctccaatcaggtgaaatctaacgcggagaatgcgcacaatgtcaacaagctggcagatgatgtggggctaaagatgacggagagcaaccagcagatgcagaccatgattgaagcgatgaaggaaatcagctcctcctccagtgagatcggaaagataatcaagacaattgaggatattgccttccagaccaacatactggcgctcaacgcagcggtggaggcagcccgcgcaggagaagcaggaaaaggctttgcagtggttgcggatgaggtgcgtaatcttgccagcaagtcagcggaagcatccaaaaatacggcggtgctgatagagagctccattctggcagtggaaaagggcactaagattgcagacgagacagcccacactctgttagagagcgtggaaggcgcccagaaggtaaccagaaccatagaccagatttccaaggcatctgaggagcaggcatcctccatcagccagataacccaggggatagaccagatctccaatgtggtgcagaccaattcagccactgcggaggaatcagcagcagccagcgaggagttatccggtcaggcacagattcttaaggggttaatcagccagtttaagttgaaggatatgggaagtgcccccatggtgatgcaggatgttccaagacagatggagccaattcccgcttacccggacggaagtaaatactaaacagcagctttgaccagggcaggggcagcatttatgaaggaaacgctgcccctgtctttttgtttttccggcttcagccagttaagtccgcggtttatgtccgcatatactgcatgtccttaatattttcccagaagtagtttacgttgctcttaaatatcagtactatttccaccctgcgtaccttttccgctggttccttatccatgagcaggtactcataaagcatcttgatggcaagatatgcctgcttacaaggatccttgaacaccagattggtaaaggttccttcctttaaggccctcaccgtctcatcaaatacatcgcttgcaatgactggaatcctgcctgccatcccgcttttctttaatgccctgtacaggacagcgctgcctctggaaaacacgcagcaaatcagatccgggggattttccttcaaaatatccagcacgtttttatccagatggtctaattcataatagccgtataaatcctcaacaacatactccttcttctcctgccgcatatattcatgaaacccttttgccaccagataatgggaatccttataggggtcacctgtcatcagtagaatgcgccggcccctggccaggatattgcaggcctgttccgccatgagctgtcctgccgcgtaataatctcccaccacggttcccaaatggccacaccggtcctggtcttcggtcacaaaaaccacaggcagccctttatctgttaagtatctgactgcacagattcccttttcgtctcccggcggaaccgtcagaagtccgtctaactcctcccccgccttcaccttttcacataatgcttccagtgtccgggaaagttctcccttttcataggccagctcctgaatctccaggttaaactcgctctgttccgccagatacattctgtatccctgccatatatagctgtagaaatacttgctgtcctgatccagtttgggcaggcatactgcaattttcatatttttccgtttcagcatggatgccatggcgttcagcctgtaaccatttttttccgcgtaggatactattttttttctggtagcttcactcaccccgggctttccataaatcgctttatggattgtattaagggacacattaaaatgctgtgccatatccttcatggtaatctgtgatttcatgtggttttcctcgttttctcagaaggtcaaattatatttaaaacaagccttacgatatatcttatacaatccttcgctttttttcaagtccgcaggcagcaattccatagaatgcacagaatccggtttggagaactccggtttggggaaatccgttttattccagctgcatcagacagcccatgaaaagaggaacgttctgtctggtatctataatcatatagaaaaacggtctgtcaaggaaaacctcctttggttcttctgtttgaacggcactgccctccgatacctcaactgccgtcactgcccctgcttttgttcctttttcgtccacatcaattttagtcttgtgaatcactttgcttatataaatattatcattatctgaatgggccatggaggaaaaatccgctttttggctgtcaaatgcatctttcataccagattccatcagggactcgttgagaaccacattgtattccactgtaaattttggcaatctgacacagacggttttattacgggtctgttcaagaaggtctgtaatcccattttcctttaacctctccaggaactccttcatcgtcataccctcatcgggcaggaccgcggcaaatgcataggcgccgtccccatacggttttaggaaacccctcccccatgtattttcaagatagactgcttctgtggaatacatgaactccgcgggctggtgttccccgttttccgcgttaaatgttcctttatgtatctggttctttttatagatatcccgccattccccgtcaaaggacagcgcattgaccaaatacataaccgcgtcccggggcggcgcctcttccagcagtttctgaatcatgccgttggtttccttctttacccagctgttgatgtcatcctttgtgcccgcgtcaaagggagcctcaaatatagatgcatcgtaataattccggctggttttaagaaaatcctcatttatagccaggctgtccctgtccctgaaccatatggaatttgctatattgacctggcaggcctcgctgttgggcatataatctgtatatgccttcagataatcattcagggcagccgtatccgtatgcatcatctgctccatctgcgcccgcgtgctgccctccgctccatttgcagtcattcccagggcggagacaatggaaagaggcgaaatcagacaattgtcatgggacaggttttcactcagaagttccagagaaaattccgtaagttccttccgtggatttacagattcataggatggctccataatatccactgtctccacttcttccttgggtatattccgggtaagatcctgggtgcccttatgaaggccatttaaagcacacccggatgtgagcgcagataaaaatatggctgtcagaagcagcccagctcccagatacttccttttccttttcgttatcatttgcatcaaatgtttcataatattcccctccctgccgcggatatgcggaaaccttatgattactttaccatatccttccacgtattactttaatccctgcttacggttctatgttttttctctgaaggccgcagaaaatgctgcgtacaggctgcaaatactctcttaatatacttcatactttttttataattttattagcactcacctcttgacagtgctaacaatcgtgctataatacaagcataaagcaaatgaaaccaaacagttctatgagcgaggaggatataacgatgatgttaataccaagaagaaactacggacttaatttatttgatgactttttcaatgacccattctttaccagcgcctccgaaaagggtgaggacgccaagaagcttccggtgatgcgtaccgacatcatggagaaggatggaaactatattttagaaattgaacttcccggattcaagaaggaggatatcagggcagagcttaaggacggatatctgactgtcagcgctgatataaccaagtccagcgagggcaaggatgacaagggcaccctgattcacaaggagcgctataccagttcatgtaagagaaccttctttgtaggcgagcagattcgccaggaagatatcaaggctggttttgaaaacggcatactgaggcttcaggtgccaaaggatgcgcccaaggtggaggagacacccaagtatattgatattctgtaatcatcattgaatgcccaactccttttatatatattatccttaataacggacacagccgtgaatcccccatcccggctgtgtcctttttgattcttttatattcttttatattctttctttcatcctatgctttccacaaaagccggtcctccttgatggttgccagcaccctgatatttcgtatctcatctgcccctgtttccagaggattctgttccagcaccacaaaatccgcctttttcccgggcgtgacggttcccttctcattttcttcaaaatactggtatgccccgttgaccgtcactgccttaagcgcatcccacatcggaatgcgctcctccggtcccagcaccttaccatccctggaacgccggtttacagcgcaccacagagtctccatcatgtccggcataataaccgggctgtcctggtgcagggtgaaacagatgccctccttcagggccgatgcagccgggctgatgcgtcccgccctctcctgaccaaaattgcgtacgtggatatccccccagtggtatacatgggccaggaaaaaggagggaatgattcccagtttctttacccgttccagctgatccagtcccagaagctgggcatgaatcattaccggccggatatcgcccctgtaaaaaccaggcttcctgctgttcccgctccccagttccctgtaaactgtctccagcatatccatatactgctctgccgccctgtcaccattgcaatgggccagaagctgcatgtcttccagctctgcctttaaaatattttcctttacctggctgtcctccagggtattataaccgcagtaatcctcttttgctgcccgggtccggggcaatgcatccgcctgtgccttttcctctgcatccggtgtttccggcagatagggcgtacgcatccatgccgtccttccctggggcgagccgtccaggaacattttgtacccgcctatcttcatatgccccttatagttctttatatggctttcaaatgccgtccgtgcagcatcgctgtcccgtatatccataaaggaaattaaatccagctttaaaagccctgatttcagcagcatctgatacagcggcaccagctggcttgccatcagtccctcctggaccgtggtgattccataggaagcatagagttcctgggcgcggccgtaggcagtcaggaaatcttctgccgacggcatggggatgcgtccctggaagcctaagaatgcattttcctccatatatccggtgggcagcccgccctccatttctatgacgcctccctgaggcgcctgtgtctgtccggtcacacccagaaggttgagggccatggtgttaaacacccccatgtgacctgactggtgtttcagtatcaatggattctgaggcgctgcctggtccaggaccttcctgcggggatggctgtgttccttcaggcggttgtggtcatatccggacgcagtgacccattttccctccggaatcttcttatcttcaatgtattgccggatgcatgttatcatgtcctcaaaactgcccgccccgcccaggtccacttccattgtgtggctggcgcaggccgtaaaatggctgtgggaatctataaagcctggcatcatcacccttccctgcaaatccagcctgcgggccttatcccctgctctttcctttaccttttcccatgttcctgtctccaggattcttccgtcttctgtcagcacggcttccacctgggggcacctgtcctccatggtaagaatggtgccgttatagtaaaccgtctgcgccatgtcctgtcctcctgttctatgaattgactttccctgtttttcttagtatagtacctatattatcactggtacagcgtatcgcaggtccttgtgcacacggcgcccgctatccgcagtactaaaagtatgcacataaaaggagtttcttatgatatgcaggtgtattacatggattaaaaagcaccctgtcctctcactctttttcctgatactgatgtatctggtgattggagccacagctcccttctatcactataagccaatttcccaggaaacacaagatacggtgtcggctgagaacttctatcaggagggagacagccgtgaccgcgccatgatactggaaaccaatcagagcgcctgggatgaacggatgcgcctcatgaacctggccagggaacggattatactgtccacctttgatttcagggatggtgagagccccagggatctgatggcagtcatgctccacaaggcggaccagggagtcagcataaagatactggtggacgggttctccggcctggtgcgcatggagcccagcaagcttttttatgccctctccagccatccaaacattgaaatcaagatttacaacaaaatgaatcccctgcttccgtggaaaacccagggaaggatgcatgacaagtatgtgattgtagatgactacggatatatactgggcggccggaatacctttgattatttcatcggttcctatcccacggattccagaagccatgaccgcgaagtcctggtctacaatacagcccacggcacagacaggggaaaggacagctctctgtatcaggtggaggattactttgagcaggtatggaatctggatgtgtcctccctgttccatgacagcgaaaagaccggagacaggacctctgtccggaacgcggcggccatgctgagggagcggtataaggtcctggccatccaatatccggatctgtttgacagtgaggagaattctgccggctgcaccgccgcgcccggccagcccggctgtccggccctgcccatggattcaagcatcaacgatgacgattaccccgccgccccggatatcccggacgccccggataccgctctccccctgttcccggccttatccctgaccgccaatcagtcaaaggccctggagtattacggttccaacacggttcccacggggaaaatcaccctggtgtccaaccccaccggcatctacggaaaggaacctgtggtctttcacaccatgtctgttcttatgaaggacgcaaaaaggagtgtgctgatccacactccctatgctgtattcaatgactatatgtacgataccatgaaggaaatcacggaacgggtgccggtgaccatgatgattaattccgttgagaacggcgacaatttttttgcctccagcgattatcccatgcacagggacgcatttgtggatacgggcatggagattctggaatatgacggcggtctctcttatcatggcaaatcccttgtcattgacgatgaactgtgcgccgtggggtcctataatttcgatttgcgcagcacctatctggacacagagcttatgctggtcatccagagcccggagctgacagcccagctggaagaatacatggtctcctaccagaaggactgccgccgtctcctggcggacggagcatatgaaataccggaacatctgaccattgcagatgtcccggcgtataaaagggcggcctggaaggtggtgggctttgtgatgcagcccttccgcttccttatataacctttttatccctccattttcctgtgaggtaacggctgaaggatatgacataattggcaatccagcccatggggaccgcgtaccacacggctgccacgccccatatgggagcaaaatggaaggctgcgtagacacgtatggtcagattcaccagattggcaatggtaaataccagcacatccccggagcctcgcagaactccgtccgtacacgccttcataccgatgaacacaaaaaagtaggcgataaaggacaggtatcccgtgcccgccccataggcttcccggctcatgccgtctcccaggaaggaggttatgattgggccgttaagaagcaccactatcacggctatgatgacagagaaaccggccacaatgccgtagctggccctgtacccctccttcacccgctccatcttcccggcgccgatgttctgggccgtgaaggtggctacggcgttgcctgttgcaatcatgggaaccacgcagatggactcaattctgcttcccgctgagtaaccggccagggcagcggagccaaacccattgaccacggactggaccagcagcattccgatggatacaatggactgctggagaatggacggcaccgcgattctggtccctgcctttaacatgctgctgtcgtagagcctgaaaccatccccgtcctcctgctcatatccccttaactttttcatcaggatgccgaaggatatcagggcggatattccctgggccatgacagtggcaatggccacaccgtccacccccatccccagccatgtgacagatataatgtccagaaccacgttcaggatggatgaaaatatgagaaggtacagaggcgtcctggaatcccccattgcgttgaatatggcggcaaggacattgtacataaacaggaaaggcattcccaggaagtaaattcccaggtacagctttgcctggcccatgatattggccggtgtcttaagagactccagtatgaggccgttcaggtataatcccgcgctccccagcagaatgctcacaaagaggaaggtgatcagggccgtggaaatggaggttttcatttttccgtgctgtctggctcccagatactgggaggtcaaaaccgacgcgccgtttcctccccctatggctatcatgataaacacattggtcagggcataggaagcgcccacagccgccaacgcgtcctcgcccacaaagttgcccacaatcatggagtccgccatgttgtaaaactgctggaacaggtttcccagaatcatgggaagggcaaacaggagaaggcggcgccccggactcccttccgtcaagtcaatccgcttttttatctgctttccctgttcacggctttttgctgcactctgattcatgttcttccctcaatcattcatttgtatggatacacttcttaaattcctcaatcagctccccgaagaaaccaagggcttcatccaccggccgggtggtggacatatccacaccgcagagcttcagaagatcaatgggcttcatggagcagcctccgcttaagaacttcttatacccttccagcgcgcctggttccccgctcataatgcggctgctgatggccacggctgctgagaatcccgtggcatactgatatacataaaaaggtgtatagaaatggggaatcctctcccactcataatcaatctggcggtccactgtcatggccggcccgaaatagtccgcattcagctggcggtagatactgcacagactctcagccgtcaggctctcccctctggccgcctttttatgggccatatcctcaaactccgcaaacatggtctgacggaacagggttcccctgtagctctccaggaaatggttcagcagatatgccttttcctccctgctgcccgccttcttaaggagatggcgtatcagaagcgcctcgttgcaggtggatgccacctcggccacaaatatcttatacccggcataggtaaacggctggttcctgtcggaataccaggtatggatggaatgtcccatctcatgggccagggtaaacacatcgttaagggtgccatggaaattcagcagcacatagggatggctgccgtaggtcccccaggaataagcgccgctgcgcttgccttcattttcatagacatcaatccaccggctgtcaaatccctgctttaacaaggacagatattcctctcccagcggagccaggccctccagcacaatggactttgcctcctcataggtgtaacggcggtcagccgctgccaccatgggtacataaaggtcatacatgtgaagctcatccactcccagcacatccttccggacccgggtgtattcatgaagcttcatgatattttcccgcactgccttcaccagattgtcgtagaccagctcaggaacctcgttgtcagccaggtaatactcccggctggaggcatacttctttgcctttgcgtagaacacggcctgcttcacattggaggaaaatgcagctgccagagtattggaaaactgttcatacacactgtataacccctcgaatgcatccttgcgtatcctgcggtcctggatctccatcagggaaatgtaattgccgtgggtaatctggattccctccccattctcccccgtgataacggggaacttcacatccgcattgttgaacatggtaaaaatctggctggcgccctgggtggcgtcataggattgggccagtagttcttccatctcgccggacagggtgtgatcccgtctggcaagaatgatttccagcgcccgtttaaaatggcctatgccgttatccgccgccatatactgttccagaagctcccggtccatggacagaatttccggcaccaggaaggagctgctctcagccgcccggtaggacagcgtctgggccctggaaaacatatcctggtatctctgcacggtggtatcctcgtcggaacgcatcctggcatagacatacagacgctctatcttctgggaaagcttgtcgtcgaacaagaggcaggcatacagggtatccgcggacccggccagccttcccttgtaggaagcatattcgcttatttccccggcagcctctttaaacatctgttcccactggctgtcctccgccaccatatcctccagtttccaggtatacttactatctgcttcgcttcgttttttcatgcagaacacactccttccaatacaatattaaatgggcgccctattaaatttattttaaattacacgctaaattaaattcgctgccagaggaaccacaataaccgtcatcagccctgccaccgcaatggagagactgctcatggcgccctcgatttctcccatctccagtgccttggccgtccccaccgcatgggcgctggttcccatggccaggcccctggcaacgggatggcggacctttaaaagctttaacacggtctccccggccatattgcctaacacccctgtaagtatgatgctcatgaccgtcagtgttacgatgcctcctgcttcctcgctgatacccattccgatggccgtggtaatggatttgggaagcagtgtcacgtagtggacatgggccatgcccagcaccttgcacatgaggaaaatactcaccgcactggtgaccacccccgatgtaatacccaccgccacggcgtcagcatgtttcttcagcagatgcagctgcttatataatgggattgccagacagaccgtggccggcgtaaggagccagctgagataggatgcacctttattatatgtttcataatccattcctactcccagaatgcaggcaataatcagggctgccgacaccagaagaggattcaggatagccagttttgttttattcttaagccagcaggcaaacagataggcgcctatgctgagcacaagaccgaaatattgtgtttgttccagtatcaaccgtatgccttccctcatgtcactgatcctccctgctgtgttttctgcccatgacccactgggccatgcatccggtcactgccatgaccaaaagggtggatattcctatgattatcagaaagggcaccagaactgccttcacctctccgatgcattccacaatcccaaccgttgccggtataaacatcatggtcatggtatccatgagaaaattacccgtgccctccacgctctccagcttcacggccccgcacatcagggctgccagcatgatgaacaggccgtacacaccggccggcacaggcaggggcaccacatgattcaatatctctcccgccagggttatgcccaggataattcctatctgttttacatatctcatatcttttgtttcctcctgctgcgttagagcgtgttttaagccatgctccgattatgtttgaaattcgcacggcctttattctaccactgcatttttccataatcaaccagaatacagataaatacacaagaaatacaatcttgccattgcaatgaacgccttactgccctacaatataggaaagtccaaaggtaagaatccaggaggccgcgcccgcatgaatatgatgcataccaataccgcacatacaaatctgactcgtacgaatatgactcatacaaatatcacccatacaaccacattatcccggaaagaacaggaagatatacgcaggattacgtccctgtgccgcctgacggacggtctgagcctttcctgccctgaggacggggatgaatactggcttctggaggaggacgccactgcggctgctttcctggccgtgtataaaacagaggaaacaatgtgggaatgctatgctttcacacacccggattttagaagaaagggatatttttctgcgctcctggagcaggtctgccagtacagcgaggccctgggcgagccggaactctgccttgtaaccgacaacaagtgcccggcggccacggccgctctccgggaactgggggcagagctttggaatgaagaatatatgatggaatataatacagcagccgattcttctgaggatggaaaatccgcctcccacgcctccctgccaaacagagcgtcggacggagcggatggcagaaagcaggatatagaactggacatggacatccgtccaactccggaagggctgctcatctgcgccagaaggccgggggaccatcccgccgcggacaaggatggcataacttcccaggacagggatgacatgactgcccggaacaaagctcacagcactgcacggagcaaagcgcacagcaccgcacggagcaaagttcacagcaccgtccaggataacacctccggtacagacagcacaccggacgcctgcgttacctgccgtctttccctgaacagcaccgccgcatacctgtacagcctggagaccgctccggccctgcgacgccgggggctggccagctgttttctcatgcagctcatccgctgtctggagcgtgagggtatccggcggatctgcctccaggtatccggctccaatgagcctgccctgcatctctatagaaaaacagggtttcgcataacggaaaccctgtcttactatctctactagagcctgtctgaactatctgataacagtctctgtcagtccctgcgcaccgtgacgccctgggcttcaattttcttgcgtatctccagcatcttcacgtctgtgccggcaatgacctccgcacactgcttcagttcctcgctgatttctccgttgtcgtcaataaaggacttcttatactttaactgatggtccaggctggcccagaagtccatggcaatggtacgtatctgcacctccacacggataggcttcttgctgtcggagaagaacaccggtatctcgataatcatgtggtagctccggtatccgttgggcttgggattctgaatataatccttcaccgcaatcacctttacatcatcctgccttatcagcatatccgccacttcatagatatcatccagaaaggaacagataatcctgattccggccacatcatccagatttttctccatggactccaatgatatctcgaatcccctgcgctgcagcttttccactatgctcttgggcttcttcacacgggactttatcatctcgatgggattgcgctggttctttacggacagctcgtcattcaacacttccagctttgtcttgacctccctgattgcacaggtatacctcatcatagcctgctggaactggcgagcctggtcaacccacatctccggcacctggaccatatccggtacattgacgatggactgatgaagctcactgttgggattgatgttaatgttcatcggttcacctcattatctatggtttactgctgccgcagttttttataatgcctcgactgcctttacagcctcatcaaaccacggcatttcaagatattccacccgtcctgcatccaccatctgggcaatggcaggatcaattggtatctgagccaggaccttgatgccgtgctctgccgcgatttcctctacatggccttctccgaatacgctgatgcgtttgccgcagtcgggacattccagataactcatgttttccacaactcccacaatggggatatccatcttctttgccatgttcactgctttggccacaatcattccaaccagttcctgcggtgaggtgacaatgatgatgccgtccacaggcagggactggaatacggtcaggggtacatcgcctgtgcccggcggcatatccacgaacatataatccacatcctgccataaggtctcagaccagaactgtttcacggctcccgcaatcacagggcctctccagataaccggatccgtgtccttatccagaagcaggttggcggacatgacttccacgccttccatggacttggccggaagcatcagtttgccgtcaggagatgtggccacaccctcattgccgattccaaaggccatgggaatggacggacctgtaatgtcagcgtccaggacagctgttttcttgcccttgcggttcatgcttactgccagcatggaggtgactaaggacttgcccacgcctcccttgccgctgacaacgccaattactttctttacggagctggccggattcagtgcctccagaaactcacttttatctgctttgcggctgtcgcagtttgcactgcaggagccgcagtcatggttacattcactcatttttttgttctccttccaatatttctaaacctaattttcattataaatccatttcacaagattgtccattgttttctggctgccgtctgactggctgccgtcactctcctgccgtcactctccgctgccatcactttccaccgcggccagcagacgcctgagggcaaatcccggccgcctgaccaaggcttcctccaacactgccttattggaatccgagtgttccacctcccgggaaaaccggtgggccccatccgcaaaatccaaaaaagtaagccggccgccctggtctgtccacagagcctgggccagctcctcaatcagcagggtggctgttgccgccatcttcatttttccatagggattcccgttgtaaacagccccgcagaaataggtgaacacaaaatacaccatgagctgttccttaagcaccggcagccgttttccaatctcactttccaggaatgccctgcgccgcgtctcatatgcctgcctgcccttcccgtaaagagctgccttcatcccggagacaaaagccggccagtcctttcccagaacctccatttcggaaaacagggaaaaggcctcctccatgacctcatacctggaacaggacgccctgtcccagcctgaaggaagccgtctgcgctccgccgccctgcggtaccgctctataagcccgtccgcctcatagagccgcccttttctgatacgggcctggaggtcgtgggccagtcccaggcacatggatgtcctgtcttcccaagaccaggtacggtctctgaggatatccagtgccagttctctggcatccatcagcttggtatagagaaagaagtcaaagtcctcatatgtctcctggcgctcatcctccctggtaataaaccgcaccggttcctcacagcccaatatgatctttgccgcctctatgcaggaaaggcagagcgtcatttccctgcatccctcaaattcctctatatgcctgggatatgtgcggcaggtacggcacaggtactctggcccggcctcgctatagatgtcacatagattttcctcatttaaaaacgcgcaccgtccatggtactgcttaaaggaaccttccttccaatgaatggaattatggagcctgctgccaaagggtccatccatgtccctgtacttcttaagggatgccctgtcaatcatgatgccccatcccgcgcagcaggtgtccggacagccggacgcagtacatttaaagtgattgtaatagtggggaaatgtgtatatcatttgtacctccttataaatgctgcagccttcccccgcagggcagcgcttcatagatggtgcatcccatctgttcttcaaaataatcctttatttccagcacctttttccaccggggaatggtgctgggatgaaccccgtaccggatggtcacgtccacgaacctggtttccagaggacagaatcccgtgggcagggccaggctgtcgcagagctgtaccagacggtcataatcgtcataaactgccccggaaataaactccttcataaattcataatcctggggcgtcacgtcaaactcaccgatggacgtgcctatatcctgtatcatgaacgcatggctcatacagattctggcagcctcctcccatccgtgttccatgcatctgcggtatccgtctaacagatggcgctccgatgtccggcccgcatatctgcctgtatcgtgaaggaggcccagcacataggcccggtccctgtccatgtggctgcacctggaagctatgctctcacaggcagctgccacgtacagggaatgctccttccagggtcccggatttaagtccgctgcccacttaagctctttatttgccctctctctgtccggtatcattgtgtccctcctgctttcattcttccggtttccagccttcccaggcagaaaacccctgttgttttaacggaactccgtttattgtactaccaaatcatacagatatctaccttgtatttaagatttaacatgggaatcccttacaacatgccgcggcatatctgagacagcaatgtcccgccgcagcaaatgcttggctgcggcgggacattgtatccatctgttattataatctggttccggttcttaaaaacggtccgggcactcctattttaccaatgacaatgcctccagcacgtcctccggacggatgggaagcttgtaaaactgcctgcccactgcattggacactgcgttggctatggccggcgccaccgggacaacggcgcactctccgatggacttggctccgtaaggacctgtctcctcctcggagtccaggaaatccacggaaagcttcggcatttccttcacgttaaggatgtggtatttcttgaaactgctggtctggttcctgcccgtgctgtccagcttcatttcctcgcatagggcataacccagacccatggaaataccgccctccagctgtccggtgatgcccattggattcaccacccgtcccacgtcatggactgcggcgtattccagaaccttaatcccgccggtgaccgtgtccacctgcacctttgcaaaatgggctccgctgctcatggggcctgcctctgagtggaacatataggagcagcttaaatcctcctgatgcttttccctggcatgaaccgcaatctccttcatgctgacaaacttcctgtgaatatccacgcaccacactgcatcgtcgtggaaatccaggttatccgtggtggtatccagaagctctgccgccagtacagctatcttgtcacgcatgatttgggccgttttcactgccgcgtggccgctggtgtaggtgcctctggacgcgtaggctcccaggtccgacatggccgcgtccgtgtccgtctttatgtaggcgatatggtccagcgggatgcccagcacctcggaaatcagcatgcactgggtggtcacggatccatttcccatatccgaggtcccggtggtaaacacgatggtcccgtcctcgttcatcttgatggtgatgcccgtgatatccggcatgaaggggaacatggatgttccgtgggaaccgcaggccatgcccactcctatgaggtagcggcccttctccttcctggatgcctccatctgctttttggcctcgtaccagtcgatgagctcccgtccgcggaccacgcagtccttcaggcggaagttaccaaaggattccccgtcattgcaggccgcctcaaagggatccgccaggttcttaaggaacacgtcagacgggtccaggcgcaggctctgagcaatctcgttcatcatggacgatacagggaaaaactgctggggggaaccaaatcccctcatggcggaagccaccggcgtattggtatataccggtattccccggcacctcatattgcgggtctttaagagcttatagaacttgcctcctgccgcccagcacacggacatggtggcgctggtatgggcgcctgcgtttaagatcatggtctcatcggctgccgtgatggttccgtcctttttcactgccatggtcaaatccaccttggcagcatggcgggtgcgggtacagcagaattcctcggtcctgttgtagaccattttcacgggacggccggtctttatggctaagagagctgtcaccggctctgtgaccaggtcaatcttgccgccgaagccgccgcccatcaccggactgataacgcgtatcttgctcatgggcagctcgaaaatacgctgcagattgattctctggccaaaggcatcctgggtaggcgtccacacggtcagcttgccgtccgcatcatactccgcaatggagacatgggtctcaagggaacagtggttcacggccggcatctcgtatctgtgccggaaaacatggtccgcatcccttatggcgccgtccacgtcaccgccggagttattggattccatgatgatattgccgccctgatgaatggggtaggcgtcctccttcatggcttcctccggatccagatagaagggaagctcctcatattccacagagataagggaaagggcttttcttgcaatctcctctgtgtcggccgccacagccgccaccttatcccccacaaagcggacggtctggtcaaacaccagctcggagggattgatgtccttatcctcaccgtttccattgtaacggttcttgggagaatccttatagcagaccacggcatggaccccctccagagcctgggcctgggtggtgtcaatggacttaatcctggcatggggaacgggtgaaaataaaatcttggcatacagcattccgggcagcttcatatcggccacataccgcatctgccctgtcaccttcatggcggcatccctgaccggcacgctttttcctatcattccattcttgggtatctcacatgacatagctatcttccctcctttctcataacctgggccgcacgcttaacagcctccagtattttcacgtaaccggtacaccggcacaggtttcccttcatggcttccttgatttcctcctccgttggatccggattcttatccagaagagccttggcagccatgaccatgcccggagtgcagaaaccgcactgcacggcgccgcagtcaatgaatgcctgctggatgggatgaaggcttacgtggccgggtgatattccttcaatggtttcaatggccttccctcccatatccattgccctcacggaacaggagttgacagcctcgccgtcaatgatgaccttgcaggagccgcagtcacctgtactgcatccgcatttggtgcctgtcaggtccatgacctcccgcagggtgtaaagcagggtccagtttttttccactgctatattataagttcttccgttaacgtttaatgctactaattccatcttgacctccctatcagttatattctgcctctatgcctcttcctttttttcgccgggaagaatgatattcagtaccagggcagtgatggccgtaccggaaataccggtaaacagcgtaactaccgtggagggaaggaacgcaagggttcctgcggcctgggcaaagttgccgccgattcccactgccgccgccagggcgatgatggtaaagtttctcttgttgttctcgtcaaagccaataaccttgataccgctggcaatgatgtttccaaaggtaaccagcaggatgccgcctaaaaccgggttgggaatcagggccagcacctgggagaacttggggaatatggccatgaggccgaagataacgcctgcaatggctgttacaaacctggaagccacgccggacataacctccacgccggagttctgagccgccacacacatgggaagggcgttaaacagggtggagaacacaccgcccagggcgtcgccgcgcacagatgcctttaaggtttccttggtgggaaggccctcgtccgtggcagtgacaacaccggtggtgttgccggagttctccatgatggttgcaatatggatgataaatacggtgattacggcgcccagatttacggtcattccaaagttaagaggtctgggaacagctacccaggccgcgcttcccacctgggagaaatccaccattcctgttacggaacagaacacataacctgccaccatggcgatgagtactgccaatgactgcacaattccctttgcaaaatggtcgataatgacgcagattgcagcgatggcaatgccgattaaaaacatcttcatggcgtccggtcccgtggggttgtaatccaccatgtcgttccatgcattgagaatcagacacattcccactgccagaaccacagaaccggttactgcgggcgtaaagtatttgtacagtttgtcaatcacaatggggcccagcaggaacaggagcagcgtgccaagacaggcagcgccgaaggctcccggaattccgatgttgggatcattggcaaacagcaccattggcgtgatgagggtccagcttcccgcagataccaggggcagcctggcgccaatctgaaacttgccgatgcggattcccagggactgaatcagcgtggtgatacagcaggcaaacaatccgcactgtatcagaaacgccgtgtcggccgagttcattccggcaccgcttgccagcatgatggaacctgtcatagaacctgtaaagatagtaaacacgtattgaagggcccaaggtacagccttaccggcgggaaccttgtcgtcaaatccatattgcattttcataaaaatatcccctttataagtttttatacatcagttgtcaagttacgaaatactagaattttgcctctttcatgatcctggacattttagccattttccttcccaggatttcacagtttctgaatccgtccgggtcctctatctccgtggatccgtctccgggattccacagcatggggccggaatacattcctgatccgcctgtacagaccgtcattccctgtgtcaggaaaaagttggtgatggaattcatggtagcctcctggccgccgtttctggtgccgcccaccgtgattcccgcccctaccttgtgggcgaagaaatcaggatcctccactcccttaagccatgcggagcggaaccggtcaaagaaggtgcacagctgggctgtaatgttcatctcgtagaccggtgacgcgataatcacgccgtcagcctcgtaaaatttgtcgtacagctccgtcatatcgtccttgaacacggtacagcggtcggatttatcccgcaggcacttgttgcagtggatgcagaaattcattttcttggcgcggagctccaccagctccacctccacgccttcctctgcattcttagccgcttcaagggctgtctccagcgccttgtagcaggacttgcggcgcgggctgccgcagattcccagtatctttaccatattctcttcccctttcccggcgcagctcactgcaccatataaaatctatttatctcccaaggctgccaggacccggtcaggccttgccggaagttcattgatttccccgcggaccgcattgcagatggcattcaccacagcgggagccgctggaaccacagggcactcgcccagggcctttgccccgtaagggccgtccggctctccctgtggggtttccacgaaatccatatatagctttggcatctgggaggcccggagcaccttgtattttttcagtgtctgtaccagaggttttccctccccgtcataggccatatcctcgcaaagaccgtaacccagtcccatctgtatggcgcctgccagctgtcccttaagcatcaggggattgatggcgcggccgatatcgtggaccgccgcatattccaggggccttacctctccggtcagggtgtttacttccaccttggcgatatgtaccccgtaggaggtggctccccgttttgcctcgtaagtctcggccaccatcagctccctcatgctcacggactggcagtggaccatcacgtcgtgaagggatgcgtttttctcctcattcttcctgctccaggccctgtcgtggtgaagctcgatatcatccggctctgtctctaatagcttggctgcctcaacctgcaattcccgtttcatggcctcagctgtcttcttggctgcgcttcctgccacgaacacgccccggctggaataatccccaatgtgccagtggaccacatccgtgtccgctgccaggcagtcaatccggtccatgctgattcccagcacctcggatacaatctgcatctgcatccccagcgtatcggtacccatatcatgagagccggtgtaatagatgcaggatccgtcctcattcatcttaagcatgggggttgacacatcccggtgggcgcctacacagttgttgccgtggactcccagagccaggcccaccccaatccgtatatcctgatttcttgtagcctcctgctccttcaggcaggcttcatagtcaatgagctccagcgccctctttaagcagtcctttggcctggaattgccgtggggtttgtggaaaatggggtcgcagctgtccgggtccaccatgttcttcatctgcagatccgccatatccatgtgaaggaaatccgcaatcttctgcatctgtctctgccatccgaaatagacctggggcgatccgtaccctctcatggctcctgctatctcggtgttggtgtacacgggctggcactggaaacgcatatggtcaatcttatatgccttaaagaccttgtgggacatggcgccgcttacattcagggcgctggaagcataggctcccgtgttggtgtagactttaaaatccactgcctttaaggttccgtctttcatgaaccctgttttaacatagtttacggaagcgtggcgcacacgggtggacagaatgctttcctttctgttgtactccaccttcacaggctttcccgtcatctgggagagcactgccgccacaggctccaccgtcacctccagcttgcctccgaaggccccgccgatggccggcgccaccatccgtatcctgttataggacaggccgaagatacgggacatgataacacggaaggcaaaggtgttctggcatggactgtatacggtcagctttccgttgggagcaaagtcagctatggcaacatggggctcgatggccgcatggtgaatggcctgggtggtgtagcggtcctcaaatacataatcgcactcctgaaaggcctcatccacattgcctgcctctgccctggaggtccccacaatatttcctccctcatgaatgggccaggcctccggctttatggcttcctccacatcggtaatcaccgggagagcttcgtactccaccttaatcaggtttactgcctttttcgctatgtccggggactccgccgccacggcagccaccctgtctcccacaaagcgcacggtgtcgtcaaagatacgttccgtgtccggaagcttgtgctcaataaaacggaccgcgctgttgtagcgcacctggggcgtgttcttgtaggtggctaccgcctttactccgggcagcgcctcagccgcggaggtgtcgatactctttattctggcgtggggaaccgtgcttaagagtacctttgcgtaaagcattcccggcagttccatatcacctacatatatcttctgtcccgtcacctttaaggcagcgtcgcctatgggtctcggttttccgattacagtgtattcattgtccattccggtttcctcccatccgactggcagccagtaatatggccttaactatattgtcatacccggtacagcggcacagattcgggtcaatggcctttctgacctcctcctcccttgggtccgggttctggtccagaagggctttggctgacataatcatgccgggaatgcagaaaccgcactgtacggctccggcatccacaaaggcctgctggattgggtggagatggatgccgtctgaaaggccctcgatggtctcaatggccttaccttccagattgacagcctttaccaggcaggagcgggtggctacgccgtctatgatgaccatgcaggctccgcagtcccctgtctcacagccgcattttgttcctgcgagcctgagtccgtccctcagcgtctttaacagcgtccagttctttcccactgccagttcccggcagaccccgttgatattcaggctaattgtctccatattgtatttcctttcagaacatcatttaacttgttgcttgaagaaccggtatgcattgtcaaagaaaatcttctgcacggccgcttccccgatgccgtgttccaccagatagtccgcaaaccgtcccaccccgtaaggcgtgttcagatcggggtcgcaggtaatctcgccgtccatatccccgccccaggctatcacgtcctctccgcctaactccagcatgtggtagatgtggcgcagcagatagtccttgctgccattgtcatcgtcgtctatgaaccgtgagaacaggttcaggccgcacaggcctcccctgcgcacaatttccttaaactgcgcgtccgtaagattcctgggatggttgcagcaggccctgacattggaatgggatgccacaaagggacgctctgctatgtttaacaggtcctcaaaccctgcatcgttaagatgggagcaatccacaatcatgcctacctgctccatcctctttactgcttcctttccaaaggcagtgagtccggtatcgttgtttggccctgaacccagctcattggccccgttccacaccagtcccagcatcttgaaattcaggtcagcaaagcggtttatattgtccaggtctccgtttaacgcggctccgctttcaatggagcggataaaggcccattttccctcatccagtatccggtccagatccgtgattttctccaccagttcagcctggcctcctgtccttctcacctggtcgtccatgtactggtggtaatccagtacgaactgcactgcctcctgcccgcggatatcatcaggcacgaaaacagccatgacctggacagccttctggaatttctccctgtccctgagggagaactgggtggtgcagttaagataatcttctccccgtttttttaattcttctatggtgtcgcagtgtaaatcaaacagcctcatagtatgtattcctttctctccggatttgcctgtgccggctatctgtctgttcccggccgtcagctccagaacgccagggccttctgaaactggtcctggggggtggtcacatagcccacaggaaccttgcatccggtggcctcatacattttctttgccagttcctcaccgaatgccccgcagacctcaatggctccaaagccttcctctcccagacgtttggccagcgccacagcctcttcgggattcctcaccgtgaggatatgtgtctcaacctgctccaggtccaggcgcgccatgtccttttccgggtcatagcccgcgttcatgattaccatagcccacttcttcattgccataatcagattcctcctcgctatgttctctgtgtaaccagatataccccggcaggcagggcaaagcgtgcgggtttgaaccgtacacgcttaagccctgtctgccaggggactatccttttagagctcctatttcaacagcgccttcatgactccgtaataggattccatgaccttgtttaactggtctatctcaatgtattcgttgatggtgtgggccagtgtctctaaggacgggcctacgcctacggaacggattcctgcctcgcctgcatagtggctggcattggtgcagaaatcatagttggtaatggttgggttcaggccgatttccttcatttccttataaatgttctgtacccagtcctcgttcttgtcgaagagccatcccgggaagaaacgctctgcctcgatggtctcgccggtccagcacttctcctggcctactgcgtaggaaacctttgcctttaactgcggatcttccttcatcatgccgtccagaagctcctgtaagggagccagtacgctctcctttgtctcgccggtgagcagacgtctgtcataggttgcacggcagtaatccggcacaacagaggcgcccgggtatggggaggatttcacatccaccagctccaggatgccgtcgcccagcacatcgtggtgaggaggtgtcagcttgttgatttcctcgattaccttgcacatcttatagactgcgtttacacccttgtgagggctggcagagtgcgccggaacaccgaaggtttccaccacgatctcagcacggcctctctggccaatcttcatgttcagctgggatgcctcgccgatgataacataatccggcttcacataagcgctgatttcccttgcagccacgccctcgaagcactcctcatggacaacgcctgcaacgtagatatcgccggggaagtcgtagtctgcatcctctgcatagtaaagtgctgctgccagcatggcggacagggcgcccttcatatcggaggttccgcggccgtacatcctgccgtccacaatctcagcaccaaatgggtcgtgatcccatttggtcttatccggtacaggtaccgtatccatatggccgtcaaagagaatctttggacctggtttggagccctttatatggcagatacagttgccgtatctgtccacatggatatctgtaaatttgtgctcgtcacagaatttcttcatgacgtccaccaccaggttctcctggccgctgtagctgggagcctgaatcattttagttgtgagggccagaagttcctctgcccttttctcgtttaacattgacatttctttttcttcctttctatcatatactgctacttaaccaactcgtagaagtcctttgacttctgcgccagaaccagatccttttctgtctgaggagccagctctgcggtgagggcgcctgtgggacatacgtccagacagagaccgcagcacctgcatttatccatatccactgtcatttccgggaaggtgagcttcctggcatcatagcagcagacggtctcgcactttttgcagctcacacatttctttgtggtgccgtcttccttaaatggtgtgaaatggaacttcagaccggaaatatgttcttcactggggaagtttggatgggctgccctgtttacctcctggatggagctgtatcccagctctgccagacgctttgacaggtcatagcacatcttctccacatactccacgcccttaaggataccggccgtgcagacgcctacacccatggctcccgccatcatgtactcgatggcgtcatccgccttcatgactccgccggacgcgtacaggttcataagctggggattttctttggctatctggtaattgtagcgcatggcaataggcctcatggcagcgcctgtcatccagccgaagccgtccccgctcatcatctcaggagcagccttctcaatgtcaatcttcagtgtgggtccgatggaatcaatggcgcagattccgttggcgccgtgctccaggcatctcctggcagttgccacagtgtcgggccagttgccggacagcttgcagataacggggatatccacatgctccttggtgtagtccagcatgggaagcagtgtgtcctctgtataggataccagctcaatcatatgggctccggcacgttccacatcctttacaatggcctgggcctcctttaaggtatggcccacggaaccaatgacaacggctccggccgcaacggttttcggtatctcgttctcataccagttcaggcggtcggaatcagcccacttctcgcagttgatcagggaatcctggttcacggtgcccatgtggtgtaccgggttgatggctgctcccaggcggatggtctttgtcaccaccgcgccggcgccggcctcatggcccttaatcattccctccgccccatagcataagggacctgatgagagaatataggggctctgcagatggcatccgcagaagtcaatggagatatccgctccggttaattttgatttatctaacatattttacctccagcatttgtttacttcagtccgccttcccatacaatggtcttgtagcggtccggatccgtgtctccctcggtggagaacataagtaccttggaatcctgattcagtcccagctccagacgcagctcgcggtaggattcatccttcatgatggtggccagggcgccgaatgtggctgcgccggactcaccagaaaccacctgggggtctcccttaaagggagctgccagcatgcgcatgcctcttctggccacatcgtcgttcactgccaggaaggcggtcacatggttctttaagatatcccaggaagtgatattgggttcaccgcagcacaggcctgccatgatggtgggcatttcgccgtccacaatgcggatctccccgtctgccgcctctgcgcccctgtaaaggcaggctgcaggctctgcttccaccactaccataaccggaggattcttcttatacttgttggcaaagtatcccaccacgcctcctgccaggcttcccacgcctgcctggacaaacacatgggtggggcgctcctcaaactgctccactgcctcgtcagccatggtggagtagccctgcataatccaggacggaatctcctcgtagccttcccatgcagtatcctggatgaccacgccgcgctccgcgtgtttggcctcctcggccaccatcctgacacagtcgtcgtagtttaccttctcgatggtgcactcagcgccttcatcctcgatgtggcggcgcctgttctcagtggatcccacaggcatacggataacacatttctggccaagacggttggcggcccaggcaacgcccctgccgtggtttccgtctgttgcagagaaaaaggtggcctggccgaactcgtcgcgaagctccttggaagtgagcacgctgtaaggcatctggctgatgtcgcgttttgtctcttttgcaatgtatctggcgatggcataggaaccgcctaatactttgaatgcatttaatccaaaccggtagctctcatcctttacacaggcctttgccaggcccagatattccgccatattcttaaggtctgccagaggtgttacctggtactggggaatgctttcatggaaagcccttgccttctttacctccaccacagacatgatgggaagatttttgtcttctgtcttaggcatcttgtttaaagcccatttgatttcacagctcatgttccaatatctccttgatttaatattacaggcaaacgtcagacgcgtcctgccccttattaccggttacagcttctccatatggagcttcttaagctcctctgccgcctggtagatggcgtcggtcagctgctcataccctgtacagcggcacaggtttccggatatggcacggcggatttcctcccgtgtggcatccggattctcgtctaagagagccttggcgctcatgatgaatcccggtgtacagaatccgcactgaagcgcatggttctcaagaactgcctcctgcaccggatccagcttcccgtcgcagcccacgccctcgatggtgaccacgttccggccgtccaccgccggagccggcaccagacaggccgtaaccgccttgccgtccataatcacggtacaggcgccgcactcaccgattccgcatccttccttggtaccggtcaggcgcaggtcgtctctcagcatatccaaaagcctctggtggggttttacctccacctggcagggatttccgtttaatgtaaaacttattttcatcttctccactgctatacctccattcctgctgcctggcacagggcccgaagtacgatttcctggaccgcaggctccttatactgagtggaccagcggacgccggtgcgctctatcatgacctctgacacggcttttcctgctttggcaaacagctcctcagacggcttctgccctatcaggacctgctcggccttctccactctgtcaggcagtataaagatacatcccggagcgattctggcttctgtaatggttccctcagagtccatggtaagggccgcagcgcagttaagcctggatatggccagagcctttcttctgcccagcttggaaaatcccattctggttccctccggcagcttcttcaccacgaattcgcggatgaattctcccggttcaagcttaaggcttccctttccctcataaaaatccttaagcaggcatacccgctcgccgtcctggccgtacaccttgataagggcgtccgccgcaatcagggccggaagggggtcggaggcaggaaatgcattgccgatgcttccgcccagggtcccgcggtttcgtatctgcggggaacccacggtggcgctggcccatcccaggaaggggatgtgctttgcaatgatttccgactgttccaaatccgtgtgggtggacagcgggccgatgtatacatactcctcgtcctcgctgatatagcgcagctccttgtctaaataggtgatatcaagcagacactggaggtccttccatcgtttatccttttcgtgaatctggaccatgatgtccgttcccccggcgacgatacgggccttgccgccgtattccttaagcactttcactacgtcgtccagggaagcggccctgtgatacttatactgaatcatttgccgaatctcccttctactgtaatttatgtcccagcaatactgtctctaagtctgcaggattttcatagacccggcggccggtggcgttaaagatggcattggcaatggctgcccccacgccctcggtggctggttccccgatggatttggctccataggttcctgccggatcctggttttcatatatattgatgttcattttcggagcgtccatggaggtgggaaggatgtagctgtcaaaattctttgtcttctgcccccgctttccggttaccacgtcctctgtcaccgcaaagccctggcccatgacaatgcctccgtaaatctgtccctttacaagcgccggattgatggcggttcccacgtcgtggctggctgttacctccagcacatccacgtagccggtcttcatatccacttccacttcagccacgatgcagccgtaagcaaaggtggggaatgcttttccctgtcctgtttcgtggtcctgaatcagatcctggggcttaaaccactcaaaggcagccatctgtttgccggtccagagacaggcgttgcagacgccggagaaggggaccttcacatccggatatttcttcaaataaaactggctgtctaaaagctccacctgatctgctgtcagcttgctgtaatccagggttcccttcttaaggccgtatgccttctcgatttcctccagcggaaggctgtgaagctccagggcattctggatcatgactcccttcagcttctctcccgtctttctgacggactgtgctcccatgaccgttcctctggaagccactgtcatgccgcagtccggtatggaatgggtgtcggtgccgaagaagcggattgcctcatagctcacacccagggcttctgccgcaatctgggcataggctgtctttaatccctggccgttctctgccagaccggaattaatcatcacggaaccgtcctcgttgcagatcatcatacatcctgaagcgtccggagattcagctcccaggccggagcccctgtggcaaacggccaggccgatgcctctgcgcttacggcttccctcaggctggtttaagtaggccgcgtgtttctccttgtaaccggtctgctctgcggtggcgtccatgatatcctggatcacgcagtgttccacgggtacgccggtggctgtcagagctccgtcgtggagaaggttcttgcggcggaattccagttcatccataccgcaggccatggccagctcctcgatgaactgctcctgcgcccaaatcagctgaggggatgagtagcctctcatggcgccggagtgtacattatttgtgaacacaccgtatgtatccgtcttgatattatcaatctcataagggcctgctgagtggacattggccctccagttcatgaactgggtctggttgttgtaggcaccgcagttatccacctgctcgccctgccaggccacgatccgtccgtcctttgtgattccggccttgtagcggaggcggaagggatggcgcttagcggattccaggaaggagtcctccctgttgaacacgaacttaaccggctttttcgtcaggctgcacaggtaggcgcatcttcctgccaccagtcctgctccttcttccttgcctccgaaggtgccgcccagggtctcctgaaccatgcggacctggttcatgggcactcccagcacatccgccacataccttcttgtaaagaagggattctgggaagcggaatgtacggtcatggcgccgtcattgggattcaggtaacagatacatgcctccggctcaatataggagtgctcaatgtactgggtcctgtattccctctccagaacaatatccgccttttcaaatgctgcgtccgggtctcctttgcggatatggaacacggaatccttaaaaatattgtcgggatatttctcatggaccgcaaaagcaccctcacttaaggcttcctcgatggtatacacgcccggaagctcctcatactctgcatgaatcgcctccagagcctcatccaccagctcctttgactgggctgcgaccatggctacacagtcgccggagtaacggatggtatccgtcagatacatgtatcctgcccagcttctggtgcggggcatatcaaaacaggtaacaacagcctccacgcccggaatcgcttttgctttcgcggcatcaatggacactaccctggcactggaataggggcttcttaaaacgccagcgtaaagcattccttccatatatatgtccgctgcgtagcgcgcccttcccgttaccttatccaccccgtcaatacggggtacgcagtggtttaccacagaaaaatgtttttcgcctacttttgttaacgacattctgaatctcctttccagaacctctctgtcttttcttccatctctctgcgcacagcctctttgtcaagagtcaccagctttccgtccctcttaagccatgcgcctcccaccatcacgtttatcacattctgggggttggtaaaaagtactaattggtcatatacgttatattcattgatgggagtgggtcttgccacatccacggtaatcaggtcggccagcatgccctcctttatgactcccgcctctatgcccactgcctttgcgccgagctccgttgccatgcggtacaccttccttgccggcatggcctggggatccttatggtagcccttgtgaatcaggaacgctccgcgcattacttcaaagaaattgttcacatagccgtccgtgcccaggccaacggtcatgccggcctccagcattttctctatgggagctattcctccgcccacctcgcagttggacagcggcatggatatggccttcacgtctttttctgccaggatggctatttccttatcagtgacctgtaccagctgggaagccaggacgttttcgtccaggcatcccatgccgtcatatgcttccaccggcgtggtttttaaatgttccctggcccatgccggttcaaggtcgctttcactcatatgcatgtgaagcaggcatccggcttcgtctgccatgcgctttgcttcacgtatgaaatcctcgccgcaggtaaacagggtgtggatgctcatgacgcctttcacaagaccgttttcctcattacaggcctttgcaaagtcgaagttttccttcagacccagccggccgttttccccactctttctctcacaggcctcaaaggacaggaagccccgcagaccggctttctccacttcttctttttctaccgcaagagcgccgggaatggaattaggtccttccaggatatccacaaaggatgtaaccccggagtcaatcatctccacgcaggcccacctggtggtgatacgcgccaggtcatggtccactctgtcctccacgtagggccaccagaaatcctccagataatcggagaaatccgttaccattgcctctgccgtgatgccgtgggaaaggacgccgtacatatggttgtgtccattgacaaagcccggaagaagcatctgtcccggaaggcagactgtctgcgccacctcattgcttccgctgcccagggtatcccatggacccacacaggcaatccgtccttcttctatccggacgccccagccctttttcaggccctccggcgtcaatacatagtctggttttataatggccgctgccagatttccattttttatcattctttactgcctctcatattttctataagtatcattccacttatgtccttctaagcggttggtgatattgcctctcacgcagagttcctccgctgccttctgggctgcccgaagctctgtcttttcatcctctactgtcaggataacacccttttccatgactgccctgccgtccacatacacatctgtaatattctttaatgacgcggagtacaccagggtggagcatgggttgtgaagaggtactgccttgacgcactcatacgggtcaaagattaccatatccgccttcttgcctgcttctatggaaccaatctcattttccattccaatggcccttgcgccgtctatagtggccatctccaccaccttctcagccgacatggacagcggatccctggtagcgcacttctgcagcagggccgtgttcttcatcagctctatcatgtcgttggcgttgttggaagcagctccgtccacgcccagggaacaggtgacgcctgcctttaaaagctttggaataggtgccacgcctgatgacaggtacatgttggaacatacattgtgggagatcttaaggtcatattttctggccttctcgatatcctcatccgtcagatgcacacagtgcaccatcagtacgttgggtccgcagattcccatgtcaatcatggcgtcgatatcccacagaccgtggattcccttggctgcctccctgtcaaactctgtctcagagatatgtatggtaatgcctgatttgtactcgttggtcaccttccagagcatctgaagcgtctccctggtgttggaccacatggctgccggcgccacccagattttaatgcggccgttgtcgcagttgtggtagcgctcaaagatatccctgacgcccttctcgatgtcgtccttctgctgtgtgatgcccggatgcacgccgtactggattccggtgtccatgcagcctctgccgaagatgccgcggattcccagctccctcatggcctttataacgccgtcgtccagcccttcccttggatggggatacatataatccacgttggtggtgataccgctgtggatgccctccatcaggcccagcatggcgccgtggtagcagtcatcgggagtcaggttggtggctgcggggaaggtcatggtttccagccagtcctttaacaccatatcatctcccagtccccgaagcagggtctggaacaaatggttgtgggtgttcacaaagccagggaacattaccctgccctccaggtccgtcacgcgttcacaatccgtatacttggcctccattgcctcggtaggtcccacttccacaatccggtcatccttaacggctaccgcaccgtgaaagaatatctccctgtcaggatttaccgttacaatgattccgtttttaaataaatggctgatcatagtcaaaactccttttctctttgattcacacaaatgctgctctcacacgtatggttctcgcacgtacggctctcacgcgtacggctcttacaatcaggccctggctgttcccagctcctggtccttggcagatacagcgtcgtcttctgtctggctgatttcccttatgtactctgcttccacttccttgtccgtctggtcctttggaagtatcaggttcaggataatggcaaatccggccaccaggatgatggatgactccccgaagaacatctgtacatactcacccatgcctgacagcgtatcctttgccagagagatgcccagtcccagtgcaagggcaggtccgcatataagcattgccctgttggtaaatctggctcttgccaccaggctcatgcctgacatacatatcatggagaataccacgatggtggctccgccgataacgcagcttgggatggtggaaagcacgctggccagctttggacagaacgcggctgccgtcagtgtgatggcgccccagcccataacccagcggttacaaacctttgtcaaggcaacgataccggagcactggctgtaggttcctgttgcaaaacagttgaagaaggaggaaaagatacatgcaatgccgttggcgatgataccgccccgcagctcctcattcttcggctgtctgttaagaccgcctgtggccgaaaccgtaaagtctcctgacatctccaccgcattaatgaagaacagcaggacaaataccaaaacaaagttcaggtggaactccagttttccgaaagccattggccttggaacagcaaaccatgccgcttcgctgatgggcgaaaaattaatgtatccgaagatggctgctatcacatatcccacaatcatgccgcccagcactgctgccgcgctgaccatacccttgccgtagccgttcaaaatcagaatggccagaataacaatcagaccgatgacaaaattgtggagctgtcccatggacgggtcaccctgtccgcctgccagattataggcagctatggggaaacaggagataccgatagaggtgatgatggttcctgtcaccactggcgggaaaaatctcctaatttttggaagggcaaaaccgatagcaatagacacaagaccgcctataagctgcgccccaaataaaacccctaacccataattgacagatacggaaatgcagatgggaagaaatgtgtatgtcagtcccatcatgacaggcagccctgatccgaattgaatattgccgaaccgtatggggaatacctgcagaagtgtggccacgccggctcccaggatggagcactgcagaagcagtgtagcgtgtgaagtgtccatgccgcttgcatttgctaccagaatcatggggactatgtttcccacgaacatggctaaaagctgctggaatcccagcggaaatgcctgtgcgaatggagggcgtccatttaactcataaatggagccagttttaatagttgaagtacttttggatgcattcttattcatgttgttctcctttaactgattaagaatacgaaagggggcttcttcccttcgggtgttcctgacttcgtcgttacccaccctgatttgtaccaggatgtgcctgtggtatggttctttatccgtccagtgtacaggcttgacagatagactaaagccggagaaaagcctatctgaccaatgtgttcctgagtaaatagttgccggccggtacatctgtcttaaatgcaccgtcctctatgattttttgccctctcagaaatacatgctggactttatgtgaaactaccattccctggtatgggttgtagtctacatactgtttctgtgtgccggcatctatgacatgactgctgtccggccggattaccaccaaatcagcgtcgctgcctggctgtatcactcctttccttggatataaaccaaatatttttgctggattttctgctgtcatcctggcgatgtcgctgtatgtaaggccatggctctcagcctgtgaatacataagctccagccggttctccacacccggaagtccgttaggtatgaggcggaagtcccccaggcccaaatccttctggcccttgtagttaaaggaacagtgatccgtggaaaccgtatccacaatccccttcttaagtcccctccacagggcttcctggtccctgctgcttctgagtggcgggctgcagacatatttggccccctcgaaaccgggaagatggtacttttcctctgtcaggaacaggtattggggacatgtctcgcagtagaccctcactccctcttcctttgcttcctctatctccttaagcgcctgtctggtgctggtgtggactatgtaaaccggaaccgtgagaagccttgccatgtcaatcatccgggacacggcctcatgttccacctcattgggcctggacatcggatggagggatatatccgccggatgcccggctgccagttcctcccggcgcacatccaggatatcgccgttttcgcagtgtaccatcagaaggacaccgtgtttcttcatcagtgacaggagccggtacatatcacggtcctccactcccaggtcccccttgtaagccgtgtaagccttaaaggaagtgactccctggcgaatcatggagaggatttcctcctctatcccctcgtcataccgggccacggtcatgtggaaggaataatccgtaaatgaccgtccgtccgctttctcatgccaccggtccaggccgctttgaagactggccccgtggtccggctccgagaagtcaatcacggtggtggttccccccgccacagccgccctggtgccggtctcaaaatcatcggaagtcatgatgctgccgcagggcatgtcgaaatgggtgtgggcgtcgattcctcccggcgcaaccagacagccggacacatccatcacctcttccccttcaaggggattcaggccggcgcctgtctgtaggattcgtccctcgtccatgcggatatcctgccggatacatcctgacccgctgaccacaattccgttttttagcagcatccttttcacctctttatcctgtactttatcccgtattcccggttaaaccagcttcctattccggctttaaccgcaattatcgttaatttttagacaaatataaacaaaaaaaacaagagccgcaacgctttgtcaaaggttgccaaactcttgttaaggttaacaaaaatttttctctcctggtggagctttatgattatgtctacattttacatcttaatctcaaaatgtcaatatactaccaaaagattttcgtcaaacaacgcattttcatgtattacttacaattttcccaccccttctttgtgatattttccgataaattagttattctcgtccgaaaataacgacaattctaattggtatatttttgagacggagagcaaaaacccctgtccggaatagtccgggcaggggttggattacagatataaaactgcacttaatcctttaacagtttgtattaaaatggaatttttttttatttttatacaattttcggaatatgtttgttatttttctatcgagcctgtcttttcttttatgtattcaatgctcaactcatataccttattcttccactcaaccgaggtaaactgatgattggcaccttttattatttccagacgggccttttgcccgtacaggtccagatatggtccaaccgcataaaccggaaccttctcatctaactcgccgtgtataagaagcacctctttgccgtaaccttccgcctgcctgacaatatccgtctttctcacctgggagaggaattcactggacatcataagtccgcctatgtcgtagaactcctcgtagtggcccggaacagcatggacacggctgctgatatcatagtagaccacatttcccggagcccacataacagctcccctgggctgaagctgcggtatgatgttggagacaatggcccctcccatgctgtgtcctacaggaaacatattgtccctgtcacaccatggctgctcactggcccacagataaatggcctttgcctgctccacctcatccatatatctcatttccgaaaagtccccatcgctttcgccgcatccgtaaaagtcaaatttcacacatgcgatgccattgacagcgcactttctggcaaacaattcatgaagacgcatctggccaatccgatccacgcaaaagccatgataaaaacaaaccacagggaagggacccgttccctcgggaagccttacgtctccccgcagaagtttatgatttacttccaattcaacattaataaacattccttatcctcccatcaaccggtaaatgtatatcccagcagcttcggcaggaacattgttatctccgggaatataatcagtaatgccagcagtatatagagaacgattatcatggggaacgtatctttaaaaatctcctcaaaactggtttttgatactctttgggcaacaaagaggtttcctcccatgggaggcgtaatcattccgatacacaggttaatcaccattatgatgccaaaatgaaggggatcatagccaatggctatcgcgataggcgcgaagatcggcccaaacagtacgattgacgatatggtatccagaaacatcccaataatcaggagagcaatattgatcatcagcatgatcatggctctggaacttgttatggacagcatccagtctgtaatcatggtcgggacacggttcatggtcagtatccgcccaaaggtatttgccgcgccaaacagtatcatgatggtagccgatgtgatagtcgcgtcaaacatggcctggcaaaaagccttccagctaagatgatggtatacgaaaacagctacaatgattgcatacacaacaccgatgaccgcagattccgtgggagtaaacacaccagagtaaatgcctcccaatataatgacgggcatcaggatggccggtatggcctctttcagcacaaccgctttttccccggcagtctttgccttggtctcattccccttgtagccccgctttttgctggcaaaatagttataaatcatcagggccacacccatgaggacaccgggaataatccctgcgataaacatataagatacggaaaccccaatcgtaactccgtacataatcatgggtatggaaggcggtattaccggtccgatggtgcttcctgccgctatcagggctccgctgtaccctttggaataaccctgggccgtcatggcaccaatcatgatcccgcctatggccgcagctgtagcgggaccggaacccgatatggccgcaaagaacatggatgctactatggcagccatccccaatccgcccggcatggtacctgtcagcatttccgccacatccaccagcttttttgcaatgccgcctctctccatcaggcttcctaccagcataaaaaacggaattgccatcagtgaaaatgaatcaatgcttgtgaccgtggactgcgccagcatctgtgtcatattgcttcccgcgttaaagacagagaatgtagccacacagctcaatcccagactcaccgcaatggggacagtgcccaaaaggcatacaaataatactcccagcattgtaccaatcatacctctgccccctcctttcctgtgttcataaattctccaactctgcgctggataatccgtatactcataccggccattcccaataccccggccagatacataatccatttgggaacaaagggcagggcggaaagaacctgcccctggttccgtatcaaattcataagctggaatatttcataagacatgtatatcccataaccggcagcaatcacatcccccgccaggtacactgcctcaaaaaccttcgggttcttcttaaaagccaaagacaatgcagtcactctcatatgggcattgatttttcctgcccagctgattccggcaaaggatgtccataccagcagcagcctggccaattgctcgccccaggaaagggtaaagttgaatacaaatctggtaacaacgttaagtgcaataattacagtcatcacaagaaacatgcatacaatgatgtacttctcaatctggttatagaaaggttcttttttctcagtctgctccatgttgttctccttatatgcaaggccttttacttcatgtactttgcgttgatttcgtcaaccttgtttaccaaatcttcccctattccgggaacatacttgtcataaaccggctttgccgcgtcgcggaaggcctgtctctcctcatccgtaagggtaatgattacatttgtcccattgtttccaattttttcttccagctcagcctcattggaagcagaaagttcacgctcataaacaatcatctcatccacacattcctgaatcaccttctggtctgctgcggaaaggctgtcccaccaggtcttggaggctaataatgggcttgtatcataaatatggcctgtctttataatatatttctgtacctcgtacaatctgttgccgtcaatattggcaaagggattctcctgggcatccatggttccattctgaagcgccgtatataattcagagaatgccataggcactgcggacgcacccagcgcattgaaatggtcaatgtgcatctgattttccataaccctgattttcagtcccttcatatcctccggcttgtgaatttccttatttgcagtcaattgtctccagccggtagccatccatgtcatccccttgaagcctgcgggttccagattgctgaatatttcctgtcccacttcgccgtccagcacctcctcagccgcttcattggactggaataaatacggaaggtccaaaagggcagtggaatccgtaaatgccccgagaaatgccacggaagaaattgccatttccagagtacccatctgaagctgctccagaagttccgtattatttcccaatgccgaggcagggaaaacgtctaccgtaattcttccgccggttttctcttttaacatctctcctaatcggttggatgcaaggtcaatgggaactccctcctggctgacatgggctatcttgatcacgataggatctccctgggtgtaatccgcatccccggcagatgactcagctcctgccgcctctgcctgtttctgtgcctcttctttttttgtttctgaaggctgggcagctgacgaaggggcagcgccgcctcccccacagccgctcaaagcgagcgctgccagcgaaactgcggttgcgattgccagtaacttttttcctgtctttttcattcttaatcctcccacataatgattgtattcatggactgtttctgtacttcctgtatgcattaagtatagcaatgccacaattgcaaaacaatatcagccgggactaataaaaagaggtggttattatattaactgcacactcctttattatgtgcaggtaaaaatatgctgtttttcgccgtaatctcccccctcttgtatatattccagcaattttctgtgtatctctcccaatttatctttttatttattgtatcaaaagcacatttttatattatgtaaaacttgatatacttaaaataatcacagacaggagggacacatttatgtatcttgaagaactggaccttcaatatctgataaacagcgtccgcagtgtatgcggaaagcccatatttatcctgaatccaaactggtccgtcatatcctgcacacaccagggattcaccgaatatgcgcaggagattgcggccttctgcgcgtctgacaatgactatggggcggccgcctcccgatttggcatcataatagaaccgtgtatcctggaggaaaccctcatatgttacttcatgatacttgacaaaaagtccggttacatgattccctatctgaagacgttaactgaattgcttatttatccccagatatctgatatccaaaatcagacagccagttccagaagcatgttgatcaaccagattgccaacactggtcagaagagccctgagattgacaccttcatgaaggagtttgaatactcatacgactgccccagatgcgctcttttgtttgagattaaccggcatggaaaagaacactcccattaccgttttgactcctcggaatcctatctcaaacagctgattacctcatcctcattgtattccaaagaggatatatatggcttcctaagttcggacaggtaccttattttcaaagataccagctttgcgtccactatgtctgtccgtgaaatcaatgattacgcggattccatggtcacctccttccgtgattataacggtgaggaactgcactgtaccataggcagtacttatacggatttatacaaactgcgccaaagctatctggaagccctattcctcattgccaactatgattacctcaatgtagcgtcctcacatgcgctcaatatacatgattttatttttgaatacgccgtaagcctgattcccagaagctactggaacaaccgcttccagaacctggcccaggacctgggcagctctcccgccctcatggagacagccctggccctttccagggaaaacctaaacctgtcacaggcagccaaggccctgagacttcacagaaatacgcttttgcagcgctttacaaaaataaagtcccggacaaagcttaacccgctggaaaatgaccatgaccgcatggtactgcgggcgttttccctgtatcagaaccagaaaatcaccttacaagccggtatcgtaatacagccaaactccgtactccaccagggtatgcagaaaatggctgatttggtaaacaaaaactcctgtgggactatcaatataaacatccataccctctccacctccggcaataacgcgcacctgtttgagatactccgttccggctccatcgaccttgtggtagctgccaccggagtcatgaacaaattcaccaacaaccgctcccgggtgctggaattcccttttttattccagtccagcgccgaagcaaaacacatactgaatacaattatcataaaagatgtagaacattcactggattccatcggtgttaaatgcttaaacatatggaccatgggatggcggtacctgaccagcaaggagcccatccgccttccccaggatatggcagggaaaaaggtgcgtgtcatgtttaccgaatccctggatgaatattaccgtaacatgggggctgtccccatcaagatgaattacggtgacgtaaaagacgccctgcactccggtatcattgactgccaggagaatccctacagcaacacactgggaatgaaattttatgaagaacaggacttcatcacgcggttaaaatactatctgagtacagaggctctgtatatatcaaaaaccgcctgggaaagattaagcccttcccaacaagatatcattgctgctgcggcccgtgagaccacggactggatttttacggaacagcagtatgtgattaaccagcaatgcaaaaatatcctgctgacagaaaaaggcatgcatatcatagaagtatctgccggcgaggcaaaactctggaaatcctattcccagaacctgtatgcctgctttccccatcaggatttactgaaagagatagaaaaggagaaaacagaatacaatgcaaaacacagagctctcccatctttataaatcctttaaaagcatatttccaaccgcccatatcgtgattatcgaccataccggcagtgtaataatggcatgtgaaaaccgctgccttattccccaaacggaacaatacagcggttttaaagaaatccttacggttcatgccccaacgggcggtactttttataaactatccttcccccttccgctgtcaaatcagctgttcctctatataccctccaaggatattgaagatgttctgacagctgccaaaatggctgactccgtcatacaattattcctgtcacgtccaagccagtccgtgcaatctgtacggcaaagcgataccatgctgcttttggatcatttgttccatccttccaccgcagaagaagatacttacaccgccctgctggccgcggaacttggttttgatatgtccctgcccagggctgtgtgcatattccgcatagaacaggaccttaagaatccggcatcaaaaatatcttccacccgttccattctgcagaccatacacaattttgcggcctcctctggcagtcaggatatcatcggagcatttggaaacagtgaactcatactttgtcatgtaatgggggcagaatctgacaaagatataaagcttcttgaaaatatttatacgtatatcaataaaaattactttgtttcctgccgtatcggggtagggctcaccgtaacagatattggacattactgcgacagcttcatttctgcccaggctgttttcaggtacgcacagaaccggccggacagagaaaaacaaatctattatatagatgactttttggcggaacatcttgtatacgaaatcccggaacacttttttgaacactttttcaaaaatgaacttaactatgtcaaagctactcccattgcccaggagaccataggcgccctggttgcctgcaacatggacatatccatggctgcggaggctcttttcatacacagaaacaccatggtattccgcttaaaccagctgaagaagcagctgaatctcaaccccttccacaaagacaacgacaggttcaagctgatacttctctatcattattttacaaaaaagtacaatggaaaccattcgtcaggagagatgccgtaaacacaagaatgtaatgattccatgacatcgggtatgtttttcattcttctgttttctccccgggcgcccataccgccagctcctttaccagcatgatgcgcccaattattacacacacagctcccgcggtattccacccgctgcttcccaatacaaccgagtattcataggacgccagccctgctgtcatccatatgaggtatccaagggaggaaggtccttttttgcagttttgcgtatactgcctgccaagctctccgtaataattcaacgtactgcacccgcaggctgtctctgccagcataaggactgccgtgatctgtatggatatccctgtgctctgtctcatgaacactgccagaatcaggtccaggatggtaatgcccagccacagtctgcctgtctgttccatcttacggttccactcaaatccttccccgtccccctcccgttccagcatcctgaaaccgctgcgaaatacaaggcagcccacaatccccggaactatggggatccccataaaatcaatgtgaaatgacaaaagaaacattcccgccatcatccattttacggcctcattcacggtttaatccccctttccttcaggtaacggtatgtctgcttaaaccggtctgtgtttctgttattttgccggtccaggttcgtggtaaaccaggactctcctcctgagccgtcagaacatttccactgaatcagagcggtatagggttcaaactgttcccttatatccccggttccgcgccatgcagattccaccagaaaggtatccccttctgtcaccgcagcaggttcccactcccatatatcctttccgtccactgtaaccttgaattctcctcttacctgttccgggtttcggatctcaaatccttccagacggcagtccctttgcacaagatagcgggtcatggaggttccgtcggaactggacgatcctcctgtgaccgtaacatattccatgggtttatccagagtaaggatgatttggcctatggacacctcctcctctgcgccatcgccgtatctgacttttatggtatccagagtgattcccctggctccaaggcttctggccggcagcatcatcttgacaaacagctgcttaaactggtaccggccgtcctgcacagagcccgaataggactgaaacaggccgcctgctccgtcgtatggggtcatccagtattcccctatcccctccagctggggaaaggtgatttccgccactttggaggtatcctcactgtcctggatatagtatatgggaaattccttccacacatatctgtcctcaccggcagcgctccctgcatctacatccgcattcccatccatactccccatcgtatccccatccataccgccatcccagtacatctccagctctatgtgcatgggaataaacacaggatgcctcagcgcaaaataatgctgcagcagactgccggccgccacgattaaaactccggctgtcataaaaaaataaaacaaaaacgcagactgatgaatgaatcggtcttttggcctgtccatactgccctcctcttctttttcttccttaattttccttccctttctaatattgtatataatacaggcccgggaagcaaattcatttccctttcgtttcccttacattttacacaggattgcatactctgttcaaatagtatatccttagatataagcaacagtgcttacactgcaccattttcaaatatgattcatgggaggaaataaaattgaagcaggcattgatcatcggttccactgtggcggacgtgaccgtcagactgccccatctgcccgttaccggccaggatgtgattgtggagagccagtccatgtccctgggaggatgcgcctataatgtgtcggaaatcctccgccagtccggtgtcccatataccctgttttctccggttgggacagggatttacggcaactatgtaagggaacatctaaaccggaagcagattcccattctcatccccacaccagcggcagataacggctgctgctactgttttgtggaagaatcaggtgagcggacctttgcggcccttcacggcgcggaataccgttttgaaaggcagtggttcagcctggcagaatccctgtccgtgggatctgtctatgtgtgcgggctggaactggaggaggatacagggggcttcatactggattacctggaagatcacccggaatacaccgtatactttgcgccgggtcccagaatcagtttcatcccccaaagcagtctaagacgcatgttttccctgtctcccatcctgcatctcaatagagaggaagccctggaatatacaggcatcacaggaagccctgagaataaaaaaccgtggaaaaaagcggacctcccctgccgggaaggcaggttagaagcatgtctgcgggaagctgcctcccgtcttacagcctttacccgcaatcatgtcatcatcaccctgggagcccatggcgcgttccatatggagccttcgggaaagcatgccttgattcccggctgtccggcacggcaggtggatgccaccggggccggggacagccacatgggtgcagtgattgcatgccgcatgaagggttttcccatggacaaggccatccgcacagccaaccgtatatctgccgctgtggtggaacacgccggggccgggctggacgatgaagattttctgcgcctgaatgcctgatatgctttgattgccctgtatgcttcggttgccctgtatgtttcgattgcccgggatgttttggaagaaaattgtaaagatacgtaatgggtttgaaattgaactacgctatctcatggaatataataaaagtggaatataataaaatcatgacaggaaccactgcggcccaagcagcctcatggttccggggagaaatgtttgaggaggaaaagaatatgatgaccagagattggaatgcccgcagcacaaaggcctgcgtccggcctgtttcgcgctgtttgttccttctcatgatattcactgttttcatgggaattacggcatttgcagctgcagaaaaaatcgacaccgtaaaattatcattcacatgcgatcctgtcccaaaagcaggtgaggcaccggggaccgtgactgccaagaccggcagcagggagttcaccgtaaaaagcactgagtataccaatgatgtggaggtatggagcctgggggacaaacccagggtcaaggtggttctggaggcggcagacgggtaccgtttctcctacaccacatccagccatttcaagctcagcggacgcggcgcggattttatcaaggccaagatatccgacagcggcagcaccctgaacctggagtgctatctcagccaggcagacggaaaacccggtaaaatacagggactggactggagcggattccgcgccagatgggataaggcagaagaagatataaagcattatgaagtccgcctgtaccgcaataagaatcttgtgaccactgtcactgcttccggcacctcttatgacttccgaaatgaaatcacccgggccggcgattacaccttccgggtgcggaccattgcccggtatgcggacagagccggcgactggtctgattattccgatgaaaatacggtcacggaacgccaggtttcaaacaatggtaacggctcctggatccagaaccagtatggctggtggtacagatactatgatggaggatacccttctaatacctgggaaaaaatcaataacacatggtattatttcaacagggacggatacatgctgaacggatggcagcaaataagcagctcctggtattatcttggcgccaacggagccatgacccgtggctggcagtctgtcaacggacggtggtactatatgaacggagacggcgtcatgctcaccgggtggcagtatctcggcggacgctggtatttcctggacggcagcggcgccatgctcaccggatggcagtttatcaacggacgctggtatttcctggacggcagcggcgccatgctcaccggatggcagtttatcaacggggcctggtatttcctggacggcagcggcgccatgctcaccgggtggcagttcatcaacggacactggtattacatgaatgacagcggcatcatgctcaccgggtggcagttcatcaacgggtcctggtactacctggatggcagcggcgccatgtatgcagaccagacaacaccggacggttattatgtggacggcagcggcaagcggaattagtatgtaccaaaggtatttgtaaacaaaaccgcacagcatcagggcgccccggagagaacctgttttactctccgggacgccctgtacattttactccccacataacgcctcccgctgtgcctgcaaaactgcagaacaaacacaataacagcctgcccttcatctgcgccagccaccagacattcccagcctcccccacggccgccatatcagaacgcagttcctctattttcccggaccagaattcaaaatcagaccatctgctgggaatcaaatcagaaggtatcttaagctccagcttccatgccaggagtaatcccgccaaaaaaaatacggcagccgggatgaatgccattgccctcgtctttgccctcacctttgcctccgtcctttccccccgtcttcccatctgggcaaagagcgcccataccgaagttatccacaggggaatacacactccaaggccggcggcagcggacacatacgctccgtccaccaggaccttgccggacttaatctcattcctgtaaagaaaatttaacgctgctgcttttcctgtctccatcccataggatgtcccttcctcccccgtacgcccttctccgctccttgcgtatgtaaacatcatataccgcatggcgtctttgtccttggcaggcagcagtatgacatgggatgagtcatctgtgactccccgtatcctgtaaggtttctgcctgcaccagatgtattttcccgctacatccagacctccgaacagttccatggccagaccgctgctgataaggcatccgtcctggtccgagcggtagccgtatgttcctccaatcagcctgggatatgacgccatttccataagtccgtatacagcgatgcagtccgcctccccggaccttcccagtccggggttcattaccttcagcctttccgcccgggaccatgctgtgatttcaggcagcatatacctgccctgttcctgttcacggtccagcgcatgagtaatcagctgtttctccaccgcctctccttccccgtaatacataaatacatgactgcccgcatccctcatggtccaggccagaatggccccaaagccccataaggcggcaatgagtataagtatgatccattttttcattcttccaccaccctgacccggtctccttcactcactggtttgccggattctgtaatcagcttcatttcctttgtcacaggacctgacacagcagcggcagaactgctcttttccagtacatccacctggatcctcactgcctttagttcctctcccagtatcgtcttttccggctctgccgccagacagtagtatccttcattatcctctcgcagcgcctcaatgggtattacgcaggggtatatcccggattctatgttcgcggtaaaggataccaggtctcccagccttccctggccttccggcattccggccgtcacctggatttttccatcctccgccagatggtttaagtcctccacctctgtttccacattctttgactgccctgccagcttcacctgcatcatggagccctttttcaggagacctgccccggctgtctccctgtcaatctgtgccttcatctccagtccgcccacagccagcctgagctggcgcccgtcctggatccggtctcctgcctgtaatccggtatccaccacaaccccatccaccggtgccttgatttgtcctttggagtctatgaattcctctatcttcctctgctttttttgaatttcctccatatccagtttcatggactcctgtttcaggacggacatctctcttgcggcggcttcccctgccgctgtaccggcatccgacactctagcgttttccaccttctccatggcctgatacaggctttcctccaaatcctgaacctttcttccggcttccttaagcttctcatcctctgcctctaaggcgtcctcatactctctccgcaaatcctcctggttttctctttccccgtaatccacatcctcataatcttcctcagccgcatacatctttgccctggcttcctccaccttcaggtcctcttcctcctgtatatcctccaaatcctctcctgctctctcaagctccagctcagcccgttccagctcttcatcggaagccccctgctcctccagacgatccagttttttctgtttatcctccacctcccgctccgcctttctcaccgcagaatccctggatttttgtgccgactcatatgatcttctggcacttttcatggccttgcggttatcctccttcacctgttccctggttctgttctttttctgcacataatcgtgttccagctcaatggatgccttctcatgttcctccttggcctccgtcaaatcctggtttcccagctccagggctctctgggcagcggccagctgctgcagagccagtgtctcttctgtcacctgcgggaccggggcaagggacatctgctcctgtttcagcgccagctctgcctttttgtactccaggctcagggcatcccgttcctcctcaagtccttccatctgaagggtcaggaccgtgtctcctgccttaacagactgtccgggactggctgcgatttcttccacctgcatgttctccggcagtgatatgtataccgtttttccggctgtaagctctccctctccctgtattgtgtagagaaccacatcctgctttccataccctgtcttcacccgtatgacggtaaaggagtccagggccctggacagaaaggtcagggctgccataaaggccaggaatacggccgctgcttttttcacgttcattgactctcactccttgattcctgatgcggcaattccctgctccagcgtgtcctggcccataatgaacaaaaggacaggaagcaccatcataataatcgaggcagaccaggcggcacctgctttatcagccgtaatctccggcagataaagggacagcggccagagtctctgctcctttaaaaatgtcatgggctgttcaatggcattccagtattccaggaatcccagcaccagaatggaaatgattcccggccgtcccaccggtatacccacctttaaaaatatggaaaagtcaccggctccatccagcctggccgcttctatgagaggcgttgggatggatgcaaagaattttgtcatgataaagaccggaaatgcagaaaaaactcccggcagaatgaccgccagatgggtatttaaaagatggaaacccttaagaaccagataattgggaaccatggtcacctgaaagggctgcatcatgagaatgatgtagaaaagaaacaatgccctcttaccgggaaaacacaagtgggcaaaggcccaggctgcgggaagcgctataagcagctgccctgccaacaccagtcctgtctgcaggcaggaattccagaacatcacataaaaccccggagaatccagaagcagctccacaaaggggcttagggttggataggtgggaataaaggctgcctttataggagcgtttcccatgccaaagacagcgccgaaacgttccagcatttccccttcagacatcagagcgctgcccgccataagcagaaggggaagccatataaaaaggcacagcaaaatgaggaccccatgaatcaaaatacgttttaccatctctttttcctcttccggctccacagcagtgccggaatcaaaatggatgtctccaccatcacggacgccgcgctcatcttctgaatatccagagatacgaaccaatggttaaacaggtgctggagcatgtagatactctcatggggataatcccctgatatcaggtatgcctctctgaacaccttaaaggaattgataacagacagcaccagcaccagaaaggccgtactcccaagccccggcagagccacataaaaaaagctctgccaggaaccggcgccgtccacctttgccgcctcaaaaagctcttttggtattccgtccagtccggccagccagagcatcatatcatagcctgtgtttttccatatataggtcagcaccaggatataaaaggcgctttcctggttcagccagtcctgtcccctcccgcctgcccataccgccagctggtccagaagcccctggggataaagaagcagcttccacagcagcacaacagaggccaccggtatggccattggcagcatgatcgttgtcttgtacaggctccggctgtccgcagcccccgtcaccagaatggcagtccacagtgaaaaggccatcagcgcaggaatgcacaccagaacaaaatgcagggtattcttcacagccagccggaatgcctggctgtgaaagacctgtatgaaattctccatgcccacaaactgcccgcccactgcctggaaaaaggaacggaccaccacatttacaaagggtatgagcacaaatatggctgtccccccaagacttggagccaggaacagccatggcctcatatgccgcagactgatgccggaccggttccctgaatattcttttatggcttttctactccgaaaaatacagcattgccttgttctgcgcattctgagccgcctgttccagggacagtctcccctcaaaatatccctttgtctcattgatgataatatccgtcaaaacccggtccatccgaatggggtgatccgcctttgccgccacatcaaataccatccggcgttcttcctttgtaggccagctgccgttcagctcgtaaccgtcatctccgctgactgcaacggatgtatccttattatcttcccgatccacccagtcccggactgccagggtattgaccggaaggccgtctgaaaggtcctttgactggacgtcgcgtcccagcacaaagagaatgaattctcttgccatctccttattttggcaggcctggttgattcccatggtgcctgagggcaggtaggaggcgtttacattttccatggtaaatccgtgttttctctgtactgccagaggcagcaggatattgtacatgccatctatcttgtcgattgcaacggcactcatcccctggtccacacggctatattcgctgcccaaaagtccgtccaatcccggcataaggttatagacattgccccgtcccccatcctcggatttatcaaaggcagacttggcgccatttgcctctcccaggaccttcacggtctccagcagctccttaattttatccggatacggctttcctgtccgcatatccacgacttcatcgtaccgcagcatcagaatctgacgcagcagactctcataattagtcttgggccgcaggggcagatgggacggatcctcctggtaggccctcatggcttccatggacacaaggctggctgcggcctgtctgtctccataggcagccagtagcgtcatcctggtaggaatctggtaaatactcccgttttcctctgtataaggctttgacacctgctctgtcagctctcccgaagctatcatggggcttaagaaatccttcatatcctcaagtatccccttttctatataggattccgtcgggagaccgtcaagaaccagcaggtctgcaccatttccgcctaaaagctctgtattgagagctcttatggtatcagatactgtggtgctgcccgacgttgtctggccgtcaatcaattccaccctgacatccgggtgttccagctggaacatggacgcagcctggcgaatggtatctgtctgttccaggttcagcccatatacagtcagtgtctgggtaggcacggaaggcatctgagggtcataggtataatgcttcagctcttccttgccatcctgggacatccagacataaaaatcattctggtttcccgcaaacagcttcctgagattggcgcttggaaggctcagggaattaagggtgccgtcagccacggtctcccacaggcttcccccctggttcatatggtggattccctggggattggcaatgtatattcccccgctgccgtccgatgccatgggggcccacatgtcaaaatccggtgactgaaatggtatctcctctttggcggacgccgacatgccggaaatatcgtagctgatataggagctttcgctgtacgtgatataccggttccccatgagcagtcccgttcccttccattccatggaactccactgctggggcagtgaaagaaccagttctccttcaggcgtgtacacatccgtcaccctgctgtgagacaggaaaataagtccctcctcggacaccgccgcaaaatcaggcctcacatcgtaatatccctggtcatttttaacggaaaacacctggtccaaaagcatcatgggttcctgtccatctgtcagcttcatcatatatgtcttataatcatccccgccctggtacagtacataccggtttttgtcctccccccatatcatatgcagggtcccgtaaggaaactccagtccctccagcaggctgttgtcctgtttctcccacttttcacccgtccatatgtatctggaagcttttttgtctttgaccgtatacagctccagcacctggtcccctgtctggatgatatcggcggctgtctccccttcttccagggaaatgcctatactgctctccgcatatctgcccatcggtccctcctgctgcttttcctcctgtgtctttgattttgtctgctgttcacctgtgctgcctcctgctgtaccggacggcgcagcgcagccccacaaacatcctgacagtatgctgacagccagacacaggctcataagtttatttttcattgtcaattctcctcctggacaatatttgtgtcacatgtatcatatcaaacaaatctctaaaaaaactgaaaaaatggaagaatttcttttaggttttttagagatttgtctgatataattattccatatatgaatgacaatgaggatgggacaatgcggattctattagttgaagatgataaggaattatgtgacgccataaagctccagctggagcgggcgggatacgagaccgactgctgcggccaggggcaggaagccttttattatgcatcggaatacccctacgatgtgatcatactggaccggatgcttccccagatggacgggcttggcgtcctgggcggcttaaggagaatgaatattaccacaccggtcatcatcaccactgccctggacggcatcaacgacaggattgacggcctggacgcaggcgccgacgattatctggtgaagccttatgctgtcgaggaactgcttgccagaatccgggcccttaccaggcggccgggaaattttaggcagagtccctcggccgcctgctccaacatcagcctggatccggagaaaagggagctcacaggacccctgggaaccctgcagctgagcaaacgcgaatccgccctgatggaatacctgattcgcaatacgggccaggtcctccccagggggctgattctctcttacatatggggtcctgactcagatgtggaggaagggaatctggacaactatatctattttctgagacggcgtctcaaatccataggagccctgccccagattaagacggtccacggaatcggataccgcctggaaatcggagggacccatgattaagcggctccggcggcagcttaccgccctttttaccattaccaccggactgattctgaccctggtggtcatcggcatcctggtcataagcgccagggaattcaataaaaaaaacctggactcctttcagaaccaaatcctgaacatcacctcacggctccagtccggctccactgtcagctgtacctggctgtccaggctggagagcgataaccgcctgattatacatatcgaggacaacggcaggcctcttctctaccacggttcctggactccggacaccgggcgggacaccttaatcatgcgggccagggaagctgccatggccgagcgcattgacccgtcatcaaggccggtatcctcatccctgctcagaagctctgtatttacggtgacaggggacagcaatgacacctatctgggcagcgtgcttgtccttcccacacagacaggctttcagagcctgacgctgctggcccgcaaggaccccatgggattcggcctgtaccggcagggttttctgttccttcttctcaatctggccggaatcaccgcgctgatgtccgtcagctgggtattggtggggaagtccttaaaaccgttggcagaaagccagaaacagcagaatgaatttatagcggcggcatcccatgagctgcgggctccccttgccgtcatccgctccagcatatgtgctgcacggacagctcctgaccagagggagaaattcatggctaatatagaccgggaatgttcccgcatgtcctgtctggtgggggacatgctgcttctggcctcggccgacaccggacagtggagtctcaggacctcctccctggacatggatacccttctaatcagtatctacgaacggtttgaaccgctgtaccaggacaagggcgtctgcctgaagctggaactgcccgaagcctcacttcccaggatatgcggcgatgaaaaccgcctggaacagatttttgccgtcctcctggacaacgccctgcgctacacgccaagaggccgcagtgtcactctggccgcatctgttcagacagataagaatctgctctcccgcagccggagcatggtctgcctcaccgtgtcagaccagggctgcggcatggacgacgagacaaaaaagcatatatttaaccgtttctaccggggagacagtgccagaagccacaagcagaattacgggttggggctcagtattgcaaaggaactggttcagctccacaaaggcaccataagcgtatcggattcgccggacaagggcgcctgtttcctggtccgcctgcccgccgtatcccaatctcacgcttccagcaggtaacggtccactgcctctgcacagccgtcgtgatcattgtcagccaccaccacatcgcacagttcctttatgtgcggcagggcattgcccatggcaacagagagaccggcaatctgaagcacctgggcgtcattatcggcatctcccacaatgatggtctgatggagcggtatgtccagatgtccgcacagccacaccaggccgctggccttactcacattaaggggggacagctccagggaagcgccttccgcaaaggcaatagcaaggggaagcccgcatatacgggaatgaagccgttcccggatgtcagcagaggcggaaaacaggttcagcttctccaccgggaagggatgtttcctgtaaagggccgcaatgtcatccgtcttatttaccacccggtccatcatctcctggtagacgcccatatggtaatgactggtatccgccacctggcttgcgttggccagagcctgtcccttgctcatcatgtataccatcacatcctcatgggcagctgtttcaagaacctgttccaccaaatcccggggcagggtctctgagtggaggatgctttggttcaccgcgtcataaatcagggcgccgctttcgcatacatagtggctgacattggcaaggacatccctgaattcctccagctcgctgatacagcggccggtagataatatgacgcgttttcccatacgggcggcgcggtttacggcttccagtgtacggtgtgatatggtcttttggctgttcagtatggtgccgtccatatcaaaaccgattaattcatagtgactcatgaaggttcctctttcatttccatttttctctcctaaagaatacaccccatttcccaaagtatcaataacaaaatcacggctcccctcaagttttttatacccctttctcatggaatcgtaagaatttttcagcttttcttcaagtcttacggagctgattgtattatattggttgtatggaagtatgatggtatagaagtatgatggtccggaaatatgattggcctttattggcaggaagggagcgtttcatgaaagaaaaacacagattgattcctgtattgattttcgcatttattttgactgtcctgtgcacggctgccgtatcacgttggtacctgctgcatcagaaaggcggtacctataactccattctcctgggaaagttggtttccagcgacggcaggaagctggttttacagggaaatatcacaaatctccaaggcaggaacggacagtatgccatcacatacagccccggtataaccgcagctgacaaaaccaaggattctcatataacacctcccaccgccatcccgcagctccttgtcacatacggaccggacaaaacggaaattccttctttttcaggaggatatcaattatatgcgccggacgatgaggggacagcagaggctgtcattgcctgcggagccgaacctctctcctatctggtcggaaaggtgccggacattccctacgtcaaattagggacagatatttccctggagttcagggaaggcactgtcccagattcggtcacggttcaggacctcatactccgcggcgacggctccccgaaatacaatgaacaggtcacagaggaattcaccctggcctgttccggcagcacggcctgttttaccctggatatcaacagcgcggctctgctgagttctgatatgtcttcgtatgaagaagcaggtattttgagaggttttcgtgtaaactgccggtgggatgacaacagcacggcggaatacggctttgtcatccgcactgatgcttcatccacagaaatccgtaaccaggcagactgacaccggatgcttccataaggtctcctgtaaccatatccccatacattccgtccctttcatcaatccacgcagtacggcgttcgccgctgaaattaaagagaccgatgagttttttgcctctgccgtcctgccttaccatacccaggacagagttgtcccaagtctccagggtgcggaaaggacacccggcatccaataagggttccccggcccgtatggcctctaattgttccagattatggaaaatacggttctggactgtttctggttcatttatccgttccaccagatcccattgaaattctcccctgtgtatataccgggagtccggtgccttttcgggattgtccttataggtgtagtcattgacctgtcccacctcgtccccgctgtaaagcacaggaatgcccgactgaaacagcatgaacgcgtggagcatggtatccagcctgacagcctcctccatggcctgcctgtcatggcagaatcctgctttttccacaccgcacatggaggcggtggttccgcagaaccgggcgtcgcctgtggccgggtcgtcattgtacaggacgccccggctgaaactctccggtatccttcctgtaaagaaatcattcagaaatttcttatgggggacctgcctcatcccccacctttccaaaagaggataatccagtccccagcctatatcatcatgacaccgcagataattgaggaaggtacaggcggagggcagggaactgaccgtctccatctggctttttaagagccttacatcctttgtggctgccgtgttccagatggccgccatggtggtcacattgtagagcatatgacattccggcttttccacggttccgaaataaggagccaccttctccggctccatgaccacctcacccagcagcaggataccgggacacacgatttcgccaatcatgcgcatcatcctgacaatggtgtggaccctgggaagattgcggcagtccgttcccaattccttccatatatagggaaccgcgtcaatcctcagcacatccaccccgcggtttgccaggtaaagaaaattgaacatcatttcattaaagacaacaggatttctgtaattcaggtcccactgataaggataaaaggtggtcatcacatactgccctgtttcaggcagacaggtgaagtttcccggcgccgtggcgggaaatacctggggcaccgtctcctcaaacatagagggaaccgtccagctgtcaaagaaaaaatatctgtcctgatattccttttcccctgcccttgcccttttagcccacccatgatcctccgatgtatggttcatcacaaaatccaggcaaaggctgatacctctgtcgtggcattcatgggccagctgctccagatcctccatggttcccaaatcctccctcacctttctgaagtcagatacggcataaccgccgtccgaacgtcccctgggggtatctaagagaggcatcaggtggagataattcacatggcactgagcaatataatccagcttgccttccacgcccttcaggctgccggcaaaatgatccgcgtacatcatcatgcccagcatggagctttttctgtaccagcacgggtcctcctctctggcagcatccagcgctctgaggcgccccgcgcgctccttgtaaaacccttccattccctttaacagcccgtcaaacatatcctgactgttgtagagctccatatacagccatttcagttcgtccatatgcttatccagacgttttctgtagatgttatcgcgcttcatcccctttatatcctccttaaatgtacctggaacgcctggtattcccctgtcctggacggaatggggattccggccgacataaggcctgctcccggatattcggtccctgtatcctcatccctgtacatggcctcgggatccagtccctccaaagtgacatacaatgacagcggattgccgtgggtctccagagcaactgtatttaacagcgcctcccccttatcttcactcacaaagagccatgcggccgcttccctgtcctcaaagggattcgtcagccggtaatacgccccgtcatgaatcagatgccagtatttatggtacgcgtctatctgctccctcacgcaattcttgtcttcttccgatatagcgcttaaattcagctcatatccaaagctccccgccatggcaaccactcccctggttttcatgggtgttattctgcctgtctggtggtttggcactgctgatacatgggaacccactgcgctgattgggtagccaaaggaagttccgtactgaatccggatgcggtccaccgcatcggtgttgtcactgcaccagatttggggcgtgtaatacagcatgcctgcgtcaaaacgcccgccgccgccgctgcacccctcaatcagaaggtccggatagcgctttgtcagacgctccaggaagtcatagagtcccagcatataccggtacaaaatactgcccggactgtctccacccgccattttacctgccgccgaatatacgtccgctatgctgcggttcatatcccatttcaggtactctatatgagcgctgtcaaggacccggcagatactgtcaaaaatataatccgccacctctttccttgaaaaatccagcaccagctggcttctgccccggaccggctttcttccgggcacagcaaaggcccagtccggatgttccctgtaaagactgctgtcctcagacaccatctccggctccatccagattccgaatttcattcccaggccgttaatccggctaaccaggctgcccagggaaccgcccagcttttgtacgtttacctgccagtctcccagaccggaacaatccgaatcccgcttgccgaaccatccgtcgtccagcaccatcatttccacgcccagttcctttgcctgtcttgcgatatccagtatcttttccccggtaaaatcaaagtaggtggcctcccagttattaatcagcaccggccggggaatggtcttgtactttcccctgcaaaggctgcggcgcatggccttatggatgctacgcgacaatgtccccagcccatggccgctgtaccccatgataacctcaggcccaaagaaaatctctccaggtttaagctcataggaaaacatctcatcctgaagccccatagacatcctggtctgaccgtactggtccgtctccgcctctgccttaaaggccccgctgtacacaaaggacatgctgtaacaggggccctggttttcagttgtctcccgtcctgccagtatcagaaatggattatactggtggctggaagtccctctgcggcttcctatgacttgggcgccgtggcacagggcggttctctggaaattgcgctccattgcgtggcgtccgtaaaactgaatcagatcgtattccccgtgaaggaagtccagacatgcactgtatacccgtttcagggctgccggaccattcccttcattttccacacagactgccctggtaataatgtcgtatccggggaatacaccataaagcagcgtaaccgccagcccgctgacctggtctgtcaggcgtatcttaagggtctctgcatcctcctgtccctccccatacatggcaggaaggcctggaaggctgtatttccctttgcttatttcatatcctccatagtgcagattcagcccataggatttgtcagcatgttccacagcaagggcagggcttctgaagtcccctgagccctgatatggatattcctggggaagggcgtccagggaataggttctgtcatcaccggcctcatatggattgggtgagaacccccggtccccaaaggtaagcagatattccatggagccctctgtcctgtccccgtagtacaggtgaagcagattaccataggaatctgccttcatctgatatgtggagtggtccgtgtgaagggtgaatatccttccattttcctgatactgtattgccatgtgtcatcctccgtctctgttatccgtctctgttatccgtctctgttttccatttttatttccatccctattttccgcctgtcattgcaattccttctataaactgcttctggaataccagatacagaatcaccatgggaaccatggccaggacagagcctgccatcagcaccggataattggtagtaaactgccctctcagggtagaaaggccggcagacaaggtcatcatgttcaggtccgtgttggcaatcagaggccacatcaggtctgcataagcgaacactgcggtgaagatggtaagggcagccatgctggccttggtcagtggcatcatgaccttggtaaaggtctgccatttggtgcagccgtccaggtatgcggcctcccccagctcatccggaatgcccatgtaagcctgcctgaggaaaaaggtgccgaacgcgctgactaaccccggaaataccagcgcaaacatgctgtttgtcagtcccattctggctaacatctggtactggggaataatgaatatctgggacggcagcatcatctgtacaatcaccagggagaacagaaggttctttcccctgaatttaagctttgcaaacgcgaacccggctgccgaggaaaacgccacggcacagagcacccgaaacagaatcagcagcgccgtattcacatacaatttcataaagggcagggaggcgatggctcgcaggtagttctccttcatccactgcttcggcaggatggtcggcggaatctgtacgctctcccctgccgacttaaagctggtgaacaccatccatataaacgggaatatcataagcagggctcccgctcccagggccgcatacacaagggcggtattaatactgcggtttgtctccaatgatttcatattttccctccatcctaaacttcatagttgacccacttcttctgtccccagaactgcagagctgtcacggctcctatgagcagtacggtccacacaacaatggcggaagcatacccacggtttcctgccacaaaggactcacggtaaaagagatacatcagtgactgggcgtttgtaagggccggattggtctggtccaccatcatgtaaatcaggtcgtacaccttaagggatgccatgagccgcatgattaacaccacaaagagggtgggcgacaccatgggaagcgtaatcttaaaaaactgctgtattttggaagccccgtccaggctggcggcctcatagtagctctttgatatgttctgtattcctgacagcagcagaaccgcgtcatatcccacggcgctccagactgccaccaccgcacaggccggaagcaccagctttggattggtcagccagtttatcctgcttccgatgatctggttgataatgccgtactctgcgttgaaaatccatttccacaccatggctatggctgccggcgcaaccaccatgggcaggaaataaatggctctgaaagcagcctttgcccgaatcttcgcattgagcagcacagcggtcagcagggaaaggaaaattcccaggggcacagtcagtatacagaagtaaatggaattccaggtggccttccaaaactccttgttcccaaacatctgcacataattttccactccgctgacctcatagtacccaaaaggatgggtggtggaaaagctcagtatcagggtctgcaggaacggatacacgttcagcacaatcagacctattatcgtaggggcaatgagcagatagccccattttgcatcttctgtcaaatattgtttcttacccatcattctcctccagtcctgccatcattacggcgcctttgcttcgtccaccagtttctgcatatcttccagtccctggtccagactcagctcgccgctgtatatctttaacagcaggtcgttaatctgggttttccagttgggtctggatgcattgttgacgctctgcacaccataaggaaacatatccacgcatttttggacatccaatttgtagtcatattggtcaaaggcgcttatccatgtatcctccagccccttgtaggccggtatggcggcgcctgacagcccctggaccctctgtccttcctcggaacctgcaaatttcaggaaatcccttgcgtattccagcttctttcccttggctccggtggaataacacaggccgttggatatggtggctctgccgtctccccggaccgggtccgggcacttgggaagcacggccacatcccattttccaatcatctccttgttattctccatgaaggagataaggttccagtttccctccaggtacatagccccctgctctgacatgaatgcgttgcccggagccgtctcagcaaaatagttctggtcagggcaccacggctccttctgaaggccgatataaaattccatggccttccttgtgccggaatccagaaaccctgccctggtcttatcctcgttcagtatgtatccccctgcctggtatacgaaattccagtatcccagctgctcatccgcatatgccatatatccgtattttccggttctttcataaatctgagccgaagccgatgtaaggtcatcccacgtccaggactcatcagggtaagccacccctgccgcatcaaacatctctttgttatataccaggcagaccgtatccttatccttgggaaccccatacatccgtccgtcggagcccctggcatttgccagcgaaatatctgaaaaatggctggtataataatccggctccacatcgtcatataaatccgtcacatcctccagttttccataatccgcatatttaagaatctgattggtgtgcatccagaagatgtccggcagctgtcctgattctgccgccgcatccagcttggtccagtactcatcccagctggtaacctgaacctggatttccacctccgggttcttatccatataagccctggctactgcttccataccgcctctctgggcattgtcccaaatctggaagttcagatgcaccaatccatccgaggccctggttccggagccgcatcctccaagcaaagctgcccccagcacggctgcggccgctgtgagaattccctttctgaacgttttaagcataatataccccctgtcatccctgttccctctattctaaaaccatccaatttgtcgccttcattccatccggatttctttgataactacatgatatcatgggttttaaagcaggtaaatattctgcttacacaaaaaatatacccaaatgctatttttatacctataacttgatataggctggcatttgggtatataatgattaaaaagggggttttcaggcaatgagcaatgtactgttttccatatttcccaacgagcgtttcgtggatttggggttatatcaatacggctgggaacaatgtgaaccgctgcactcttatggtccctacgccaggaaccactatctgttccactactgcatatccggcacaggcaccctcatatccacggattccaaaggagaatcccacacctaccagattaaaagcggggaagggttcctgatttatcccaagcagatcaacacctactttgcggacaagaaccatccatgggagtacacctgggtggaatttgacggcctacgtgttaaggaagccctggagctggcaggactgaccatggatgcccctgtatatcattccaatgccagggacctaagcctggaactgaaaaatgaaatgctctatattgccaggcactccgaccagtcgccctttcacctgattggccatctttatctgttcctggattatctgacccgctcctcttcctcccgcaggctgttaaagacaggccgtctccaggacttttatatccgtgaggccacatccttcattgaacagaacttccagaacgacatatcggtggaggacattgccgctttctgcaatctgaaccgcagctacttcggcaaaatcttccgcgacgcagtgggtaagagtcctcaggaatttcttatcagctaccgcatgaccaaggccgccgaactgctaaagcttacggagctgagcataaacgacatcagcaatgctgtgggttatcccaaccagctccatttttcccgagccttcaaaaaaacatacggcatcccgccccgccagtggcgccaggaaaacaagatggctccggccacctagggccaggactatttactgccgtatcatatacagacatatggtatacagcctaatacttacagatacttctcctcatactcctccacaggtatgggcctgctgaacaggtatccctgggctgtctccaccccgcaggtacgaagcacagacatctgctcctctgtctcgattccctctgccaccacccggattcccatttttttgcagattcccgctatggactcaatgatggcctgggccttggggttattgaccatgtcgtccaccatggtcttatctaatttgagcacatcgaattccactgaggataacagggacagattcacatactccgttccaaaatcatccagggcaactgtaaatcctgcctggcgcagtttccctatgagctcctttaagtcgatttccggcgcgttccgtatgctctctgttatctcgatttccagcagtcccggagagattccatatttatcacacagcttcaccagctgttccacaaaggaggactgggccagtgaaaacctggaaaagttcactgaaacaggaaatgcctgcttctcccggtcagcccactcctttaccttggaacagataaattcaaagacaaagaagtccacctggctgatggtctgggcttcctccagaaggggcaggaaattgcccggcagcaccatggacccttccttggactgatatcgtatcagcgcctctgcccccaccgcggaccggtccgcagaggaaacctttggctgcacatagaccacaaaatgattctttcccagctcgtctgccagtacctccggattggacagattgattacctcgtcgctctgatgcctgtagcgccgggacacaggactccggcggtaaaattctttcttatcctcatacatccttgcatctgcatccgcgatgatttgggacaaatcatcgcttccctctgcccagcggctgcccactgctgccctgcatatggtatcccgctcaaaattcttcctgagcagctccaccttttcctcaaatacttccttgctccattcccggcagatgatgacaaattcatccccgccgattcggtagaaatcagctccctcaaacgtctcccgcatcctcctggcgcattccaccaggaccttatctccaaatgcgtggcctctcaaatcattgatatccttcaggccgttgacatccagatatacgatgcccaccggggattgcgtctctctcaggttatccgtgtcggcaatataccggttgcggttgtagaaggaggtcagggtgtcatgatagctgagcctgtttaattccttttcattctcatccctgcggtaggacagcataaggaaataacccagcgtgcgcagaagggggccgatattgaccagctgctccaaaggaggattatccactccaatggcaccgcagaaatgaccgtcccgttccagaggcgccgccaccagactggtgatcccctgggccgttaaaatctcatactcatttctgtagtcctccttcagatcctgcacatcctctaacaccatacattcctgccggtcaaagattttaagccagcggtcgatgaattccagaggcagaccctgcagtgtatccatctgggattccacgcccccggcgcaccactcgtattcattgtacagcttgccgtccctcagcatgaatacataagaccggtccgcgttcataaaccgccccagtttatcaaggataacgggaagtatctccccgatgcccctgtcttcataaaggctgcgcacacagtccaccagcatatcctctgcgcgaagggcaaacttaagactttgtttctccttttccgcttccgtcacgtcaaaggcaatctccaggcgggccggtctgtcattccattcgatcaggcggtcctttaacagataatggcggcctgttatggggttggtattctcccatgtgacaatattatcgtaatccgtaaaatgctcaccgcagaacggacatggctcactgcgcccgtgtaatacctcataacagcgctttccttcaatggaatccagatgaaaattcctcattccggcctcgttcagaaaaagcagctcatgggtctccacgtcagagacatacatcatctcggatatatcgttaaggggcgcgcgaagcgtatcccacatacggtccagacgctgcttctgctgccggttggcattttccttttcccgtatgacggcctgcatcttatcctgcctgcgctcctgccataccagaattccccacacacccatggccccgagtatcaggatcccgaaccccctgctggtgcggttcacctgctgctcagtatactgctctgccgctgtcacggttgtatccgccagctggaaataactctcactgagttcaaacagcgtttgcgagtctttcccctgcctaaccagcatgatctcttccttaagctcctgccactggtcttccatggatgccagcagatcctggtaggcctggtcattcaaacggatgaggcggttggcccccacaccggtggccagttcctccataatcccgtccaaacgcgcaataagggcgtcatccgcccgccctttcaattcttcctttacaaggcgctgggtggcgcctctgacaacacctgtatagttgatgaccctggcatttccctggagattgtgtatggacaccagggacaggcctcccagtcccaccagggacaggaaaagaacaatgggaatcagtcttttcttcatatgtaccatccttcataaccggatgcactccggaactttcatattttaagtataacaccaaatttcattaaatccagtgagattttactttttattctaattgttaccacaggggtgacttccatctgaaaatgttatataatattgggtatcaaagcaatgcggagaacagatatggatttaattaaccagttcatagagaattacaagaaaaagatgaacttttacgaaacagccggccggatggctgcccggcagttagagagcgcccttcaggcagccggtatccgggccatcgtgacctcccgcgccaaagccccggggcgtctgaaaagcaaggtcctcatacgcaattccaggcgggcggtcccctataaaaacatgcgtgaaatatatgaggatatcgcagatctgtgcggtgtcagggtgtcactgtacttccccggtgaccgcgataaggcggacagccttatcaacgaccttttcacccttctggagaccaagcagtttccggaacagtccaaggcgccttcctataacaaacgtttttccggttactgggccaaccactaccgggcccatatgagggaggaatccctggaccgttcccagaaaaagtataccacggcccgtattgagatacaggtggcttcggtccttatgcacgcctggtccgaggtggagcacgatctggtctacaagcctctgcagggaaccctgtccgatgaggagctggcgattctggacgagctgaacggcctggtccttgccggggaaattgccctggagcgcctgcagaacgcgggcaatgagcgcatacggaacaaaaatgcagagttcggttcccagtacgagctggcatcctacctgtataattatctcagcaacaatttccgtcccgaggacatagagctgcgcatgggcaatattgagctgctgttcaaactcagcagccgcctgaaaataaacagcgtaaaagagctggagccagtgctcaaatccgtgaaattcgagaaggaccggcgcaacatttcccagcagatcattgaccagatgattacgggaagtgaaaagcgttaccatatttaccaggagctgcgggccggccaggacggcataagcgaagacgagcgccatgcagtggaatattttttcagccagtgggttcccctggaacagctgcttaaccgcgtttcctccaaaaactcccccaaggtgcggggagccttcaatatcaacaccctgaagcggctgaatctgctggacaaggagtgcatcaaccagattgtgtccctgcgcaagatccgcaatgtgctgattcacgatatagaaattccggaagcagattatatcaaccgtcagggagacgaagcccagtccctgttccacaagctgtcggaacagtttgccgccccggcttaagatcaaaggatacttaaaccggctgcttttggcgtttttcgtggatgataatggagcacaggcatccggggcgggccatggcggcgggcacaggccgtcatcatcccctcccccagaacttgcggatttcatcccggctcagccccagcgcaaactcctttttcagcaccaggaactgttccagttccagcagacccaggtacagtaaggcccggctctcaaattcctgtctgcggacaggaagaggctgggccttcatctgtaatttcacatgttcaagctcatcaagcaaccccagggcattgttcctttcgtggaaggaaccgcttacagattgaagcaggtccgccaccaccagcgcctggtccggtgtggactccattcttgaaaagcagtcccgcatcctgcaaaggatggcaaactggttcttcctcagccccatataggcaagataatagcgcgtgtccgccaaaagactgttctccatcccctcgtatgctctgcgttctccctgctccactgcctgccccagggcctgaaacccgcggccgtccggctgctccccattctctcccggcgtccccagctctgatgccatccggctcagcaggctgatgaacatttcctcaatttccctctgtgcagagcgtatggctgtccccgagccgggaatatacaggttgagcacaacgcccacccccgtgcccacaaacagcagaagggcttcattggcaatatccgccattcccatggatccctcagccagaatatgggtcatcaggaccgtgttcacggatatcccctcctgtatgccccatttcatgcacagcggggtaaacatcagaagaaaaatccccattgccaaaggccggtaccctgccaatgcaaaggataccggccccaggaccattgccgccaggaaagccagaaaccgcctgcctgtaacccgtatggtttcccgcttcgtatcctggatactgagcagggtaatcacaccggctgaggagctgtatctgaggcccagcgcctgggcagccgccatggcaagcatgcttcccacggctatttttaagattttaagtatacggccgtacctgtgcatatacccctcccggtcactttatgacccccattgtctgttattatctgtcattgtctcccgattgaccggcatccatacaagccagggacggacgaggccggctgccagaccggcttataccccgccggaatgctctgccagcttatgctctgccggaatgctccgccagataagcatccagtatggccgctgccagtccaaccagctccttgcaggggcgcgactggtagtaggcttcggtcctgtcagacggtatgaagctgtcctttcccattccctccaggcccagaagttcccggcacagcagcgttcccgtcctctccttaaatgccccggccagctcctggattcttctgtagtgctcagtcttggcgtccttgtcatcaggactgtcatagccatacagcaggccggctgccataaatataccgctgagcgccccgcagacctcccgcatccgtcccataccgcctccaaaggaagaactcaaccgcagagcctccttttcctccataccgtgcaggtcgcagaatgctgtaaacacagactgggcgcagttatacccgtccagaaacaactccatggctttccctgcatggaagctggattccacatctattctcatgaaataccctccttttgcggctgtcatgtcctgacagccctgttcctgccggacagaagagaaccggctgtccgccggttctctgcctccggaattctccggaaaaatcacttgaaattatactcagttacaatcttctcacgcccggtggtcacatctgtaaaatactcatacaggcagattcccaggtatgaacccgatatattccacacattcctgtacccccggttcacaagggccatacatgcattatagcttctctggctggagcggcagtggagatacacagggcgatccctgggtatctcatccagacggtcccgaagctccgacaatgggatattgacggatgtctttaaatgacccaggccgtactcattcttttcgcgcacatctataatgcacgcgcctgtctccaccagctcccgcaccttcgtcacaggcacctgccgtactcttccatagagcaggttcagggccgccagggctgcctggtttaccacatccttggcagtgccgaataccggggaataacacagctccagctccttcaaatcctccagggtgcctcccatggaaatcatggccgcaatgacatctattcttttatccgcatttccccgtccaatggcctgggctcccagaatctttcctgtgggatattcataaaccagcttaaagtgcaggggagcgcttcccggcataagccccaccttgtccgtgggtatgatgtacacagaatcatggggaataccggcttctgcggctgctttttcgttcagtccggtggccgctgcgttcaggtcaaagatacggaccgcacaggaaccaatgacccccttgttattatggggtataccgtacatatggtctgccgctgccctggcctgtctctgggccggtcccgccagagccagtctggacggcttacgggtcagccggttaaacacctgaatggcgtctcccaccgcatagatgtcagggtcactggtcctgtaattatggtccaccttaatggccccagtctctcccagctccagccccatatccttagccagtccagtctcaggcgcaacaccgatggccagcacagtcatccctgccctgaccgccttacccgaaaccagggtaatgctgtcttccccgatggcgctgacaccgtcatttacgattacatccactccatggtccagcagctccttctggagcatctggaccatatcataatcaaaaggcgccatgatctggtcctgggcctcaatgacagatacatgccttccgtccatgttcagattctcggccacttcaatgccgatgaatccgcctcccaccacagccacatcccggatctggcagtcggtgacaaatttcttcagattcacaatatccgtcacattccttacagtgaatacattgggcctgtccacgccctctatgctctttggacggatgggactcgcccccggagagaggaccaaaatatcataccgctcctcatagacatccccggtacacccgttttttacccggatggttttcttctccctgtccactgacagcacctcgctgtccgttctcgcctctatgtcatactgcttcttaaacttctccggactcatcatgaccagggcatcgctgttctttacagtgccgctgaggtagtaggggagagcacagttggaaaaagacacatgatgacctctctcaaacatgataatttcagaccgggcatccagtctcctggccctggccgccacagacgcgccgcctgccacaccgccaacaatcaatattctcatttgctctgttccctttcttctgatataattctctcaaaacatgcatccgcaatgtccgcagccatacaaatcatgtcgagacagcgggtatcctcttttttataggtcttaaccagctcacagcaggcatccgaaccaaaacgctccacaaattcctccgcaaatgcggccacagccggtttaagctccggggtggcatgagccctctcatgaatgagccggtagctgatggcggaacatcctccgcacagcgcgccgcatgccttcccgcatcccattccccctccgaatccgcccaccagctttaccgaatcatccggtatacccaggcagtattcatcattcagcgcccgcagcatggcttccgcacagttattatccttttcgatgaagtactcataaatcctgtcccttgtcatcttatctctcctgtcctcccagagtatgatttgtccatattataaatattagcacgttccaagccgtcaatgcaagttctttgacattttcctccgaaaagccctatctccctccctcagccacaacctccaaaaaatcaaaatcagcataatgggcatgttttacgcggtccgcacatgtaatgcctgccatggtccctgtaaactccccgtacctgcagtactcgtcggaaaaccgcgtggtatcaaagatacgtccgattttctcatattcctgcccgtcatagctccattcaaaccaggactgtctgccctgcacatacagcctcagataaacaggccggtcctccaccggtattctggtgttgaggaattctgtctttactccattttccagatggatgactgacagagcgctctgccccagggtctcgctgtaatattttctgagattaatgtaattcatattgtcataatagagaatcagccctgcactgtgctggtggacctttggcacgaactccattttggtggtgattcttgtgtacacgctggtcagctttctggccaggatgctcaccttgtttaaggacgtcctggactcctgtcccctgagccgtacatagcccggtctggcattcacatccgcaaacctttggggcatgatgcggggcgcataataaaagtttcccagctccccgctgtcaaatccgtcaaagtccggtatcccctccaccggtgcctccggaagggatgtctccggtacctctaactttgccagattgcttttgtccgccatgcgcagccacccatcctctgtccactccatcttttggatggcggtctccctgcccagtgtacacctaagctccggcacaaagggtcttgcacagagatggaccagatacacttcccctgtgggaaggttcacatagcttccgtggccggatttttgaagcacggaatccgggttgaaatacctgggctttaaatggtccgggtcctgccgctcataggactctcccggtacgctggtgactatgggattcatggggtccccctcatagggcccccacacattcctggaacgccccatagtgacacagtggttataacccgtgccgccctccgcgcacatgatgtaataaaactctcctctcctggtcagatggggtgcttcaatgcatcccctgtccgtaccgccccgccacatgcgcctcggatatcccacgatttcttttttatccgaatcatattccaccatgcagatggagccgggtttttcatacccttcccttgtctcccattccagggaaacaatatattttctgccgttttcatcatgaaaaatggatgcgtcaaatccagaggaatgcaggtagaccggctcactccagggtcctctgatgtcctttgcggacaccagaaaattatccacgtcaaaataccttgcattcatggagttcatgaccccgtacaccacataaaaggtatcctccgcctcacagtatgtaagacatggcgcccataccccctttgcgcttggaagcttctttaggtccactttttcgtcatccgtaaggacatgggtataaagctcccagttcttcaggtcccgcgaatgatagatggggattccgggaaaccactcaaaggtggatacggccagatagtaatcgtctcctttcctgcatatacaggggtccgggttaaatcccggaagaatagggttatgtatcatctcatctcctccttatccgccgggaaccatccaaaggcagcgcaccggccaaaatcccagctgtcccagccaacccatccggcttcattgaccgtatccgtcagaagcttgtagctccagtaaaaatatccgcttcccttgtcccaggcctctgtctgggccctggccagagccctgtagatacgggctttctccatttcatccatcagctcctgtccggacccctcctcaccgtttaacacgctcctgcctcccattgtgtcacagccgcaggccagggagttgaaaagacaccattctccgcatataacatcaaaatactgctgcatttcctcaatgtcctttgcaaaatgcccgcggatataatccaggtaatcaggaagggtctgtccgcagccttctgtctccgcaaacataagatactgatgggtgtccagcaccacgttcacaaacctgtcctccctcataaaatccttccatgccttaagttcaaatccatcgtggattaccacgtatttttcctccggcatataccttctcagacagtcatatgccctcagataaaatcccctcagaaattccatggaaacaggccccgacccctcggccatggaaggctctgccgggggataacggccgggcacgtccatcagcttccacatccgctccgtgacaggctcgttcaggacctctattccccacagcccctctctttcgccgtaccgctttgccagccgttccagaactcccaggacaaattccacctctgccggattctttgaccatctgcacacgccgcatatacctccgttgtcaaagccgttctgcccttccggcgccgtatgcaggtcgatcagtatcttaagcccgtaccgctccgcccagcagaaagccctgtccagctcctccacacagccgataaagggctccctgtccccaaatatgaagtatgggacaggaatccgcacagcctccatgcccatggcgcggattgccgcaaagtcacgttccgtgatatactcggagcggtgtatcctgattctggcctcgtacacctcccttgaaagccagcggggcagataatattcatcctgtgccccggtcccttcaaacagcgccgggctcatccatttttccagcaccagccagtttcccaaatttacaccctttatatgcatgatgttctctcctttctcaccctcatcctatttcctgttccggctcttcaagtccgcaataatgcctgcaaactcagcgtccagatgatagaagctcataataaccagccctgccgcgtaaatcccaatgggaatccatacaaaacagatcctgatggatgtgagggctgaagctgactgcgcggctgcctgccccacataacctcccagttcaagaatccatcctaaaagagcagatccgattccgtttccaatcttatatccaaagctgcaggcgctgttgaccagcccttctgtgcggtatcctgtcttccactctccatagtcaatggtatctgataccatggcccacatggtggccccgccgcatgcgtttcccaggccgcggataatgctggacacgataataaggcctatggatcctcccgagaaattgagcaccagcataccgatgatatctaacaccaggcccagggaaaatacattgcgcttacccagccgctttaccagcatggcgataaagaacatgcctgcaatctgcaccacattgaaaatgccgttaattaacgccaccaaatccttgctgcccagtatatcctttgcgtaaaagacagtggagccgccgtttacggaatacattaagaaaaacagcgccagcattcctgtcatcatgagccagtatttattgcggaacagggccttgattccttccgcaaaaggcacattttgtaccggttctctcccctcctcccggacagcaggcctcacccgctcctttgtccccaggaaattaatcataaacgctgccacggacaggagcccgaacaccataaaggtcttagtccaggcagcaggagtgtttccgaaatactccacaagaggcagagtaaatgtgttgatggtcaatgtacctgccgttgccagaaggttcctgaaaatgctcagaacagacctctcatacggatcctgggtcataagcgcattcagcgcggaatacggtacgttgatagctgtatagatgaccgttgacaccaggttatatgtaatgaacacatacaccagctttggcgcggcagaccaggaaaccggcaccgagaacagcaggatgccggatatggcaaagggtatgcacatgcgcagcagccacggccttgcctttccgaacctggattttgtcctgtccacaattacgcccataatgatgtcgctgatgccgtcaaacagcctcgaaaccatcatgatgcttcccaccgcaaaggcgctgacccccgcataatccgtatagtaaaacagcagaaacgccgacattgccgtataaatgatattgcatccgaaatcaccgcatccatatgaaaaacgttccgccaactttcccggcgttaatttaccttccctgttcatcccttgtttcctctctttgtttttatataatgtccttgtttccatgcgcacgaaccttgtttccccgggtatttccttcatatatatagtatcacaggatccatgcaggaaacaggacggatacttcccatataataggtcgattttctcttcttgtgggctggaccgcaggatgatataatgatgaaaagggggattgacatggcagaaccaaacgaaaatatactgtatgagatcattcaggtaccggaggccactaaggtgcgtttcttcacctctgtggatccgggcagttatgtacccagccattggcacagggcagtggaaatcatttatatgctgaaaggcgagctggaagtcacggtggagaggaccagccgcattcttttgaccggccaatgcattctcatcaactccaatgtcatacactccaccaagtgtacccatcccaacaaagccattgtattacagattcccctggaatttatggaaacctatattcctgaggtgaaccagctccttttcctttggaatccagatacccgggacccgattaagagaacaaagcttgacaggatgaaggacaccctgacccagatgcagattgccaacgatatccggccggaaggctttttgctgcgttttaatagcctgctctttgaattattattcagctgtaccataatttcagcgtacaggtactcaaacccaatgtaaatcagaaaaacaaggatttaagccgtctggacccggtgctggcctacacggccaggaattacagccgtcctatcaccaccagcgaaatcgcccgggtggcatttctgcagcccggatatttctgccgttttttcaaaaaatgcatgggagtcaccttcctggaataccagaatgaactgcgcctttcctatatttaccgcgacctgattaccaccctggaccctgtccatgatattctggaacgccatggcttcaccaactataaattattccgcaggatgtttgaagagcatttcaaagatacgccttccggcatcagaaagaaaatgaagcaggacgggtgagaggcccgtccgggctgcaaaaaagggagccttgtttccagcgttccggtgcatccaatgatgatacaccggaacctggagcacccggctcccagttcacactattctcctaaattctggaatacagccttaagcgcaggatacatctgcctgaacttgctgtactgtttttcatatttctccgtcagttccccatctggttcaatggtttccgtcactttcacgatgctgtcagcagcagttttcacatccgggtattctttgcagcccacggccgccagtatggcgcctcccagggcagggccttcctcattttcaaccacatccacctttacgttcatgatgttggccaccatcttcttccacagcggactctttgctccgccgccgcagattttagtgcggtcaatgcggatgcccaagcttctggccacctccagtgaatccctgagtccgtataccacgccttccagcacggcctgggtcatctcctccctgctggtatccatggtcatgccgataaaacatgccctggcccttgggtcgttgtggggagaacgctctcccatgagatagggcagatagaacacatggttctcacccagcttaacaattccctcctgctccctggaaaactccttggtcttaaggatttcctccatccaccacttgttgcaggaagcagcgctgagcatacatcccatgagatggaaatgtccgtccgcatggtcaaaggaatgaagggcattgttgcagtccaccttaaagctctcactggaaataaagatggttccactggtacccagggaaatgttgcagcatccctcgccaacggttcctgttccaacggcggcagcggcattgtcccctgcgccggcaatgatttttacatcctgtgaaaatcccagctccttagccagttcctccttcagatttcccactacctcatagctctcatacagatccggaagctgttttctggtaatgccgcacagctccatcatttcctcggaccagcacttatgggccacatccagaagcagcatgccggatgcatcggaataatccgtacagaagctgcctgacagcctgtaagccagataatccttcggcagcataatcctgcatatgcgcgcaaagttctccggttcatttcgcttcatccatagaattttaggggctgtgaagccggtgaaggcaatgttggccgtgtaagcagacagcttttccttgccgatggtctggttcaggtaatctgtctccttctcggaccgtccgtcattccagaggatggccgggcggatgacctcatccgcctgatccagtgtcaccagaccgtgcatctggcctccgaagctgatgcctgccacctgtgatttgtcacactccgaggtcagctccttcatgccgtccatggaggccgtaaaccagtcctccgggttctgctccgaccatgcaggatgggggaaatacaggggatactcccgtgaaaccaccttgtggattcgtccgcttccatccattaacaacaattttaccgctgaggttcccaggtccactcctatgtaaagcatatctttccctccctgcatttttatgcaaatggattctctgtcttatatcttacgctctttggctggttgtagccgatttcctccacatccacgccaatgtacttgaatacctcaaacaatgccttgccgtagtttccgaaggcaacagccccgtggtgcggatagttcttctcgatgagcacatggcggtagaaccttcccatctccggaatggcgaacacgccgatggaaccaaaggaacgtgtggcaaccggaagcacctctccctgtgcaatgtaggctctcagcttgttgtctgccgtgctctggaggcggtagaaggtaatgctgcccggcttgatgtctccttccagtgttccctgggttacttcgattggaagagccctggccataatcatctggtacttcatctcacagaaggccagctttccggaagcagtgtttccgcagtggaagcccatgaatgtatccttaagtgtgtaatcaaatttgcccttgatatcagcctcgtacatatccttgggcacggtgttgttgatgtccagaagggtaaccgtatcctggctgataaccgtgccgatgtactcgctgagcgctccgtagatatcaacctcacaggacaccgggattccctgggctgtcaggcggctgttcacataacagggcacgaaaccgaactgtgtctggaatgcgggccagcattttccggcaatggccacatatttgcggtagcccttgtgctcctgcacccaatcctttaaggtcagctcatactgagccagcttggagagaatctccggcttcttgttgcctgctcccagttcttcctccatctcctttacaatacctggaatcctctcatcccctgcatgcttgttgaaggcctcgaacaaatccagctcggagttctcttctatctccacgcccaggttgtaaagctgcttgatgggcgcgttgcaggccaggaagttaagaggtcttgggccgaagctgatgattttcagctcgcttaatgcagccactgcgcgggcaatgggcacaaactcatggatcatgtcagcacagtcctcggcatcccctaccggatactccgggatatatgccttgatgttgcgcagcgccaggttgtagctggcattgagcataccgcagtatgcgtcgccgcgtccctggcacagattatccccggactcctcagcggctgccacaaacatcttaggtccgtcaaaatgctttgccagcagggtctctgatatctcagggccaaagttgcccaggtatacgcacagagcgttgcagcctgccttcctgatgtcctccaatgcctgaaccatatgtatctcgctctccacgatgcatacaggacattcgtaaatttctgaagcgtcatatttagccttgtaggcttccactaatgcttttcttctgttgacagaaagagactccgggaaacagtccctgctcactgccacgattccgatttttacttctggtgtattgttcattgtactttcctcctcatacatgattgatttttattgtttgcatctgaaaaacatccattgtcatctatatcagacactcaggttctcacccttaaggccgataaaggctccctccggcagaccgccctgggcatggccgataagccatttattcctggcaaataaaagcctgtcctcagggtccttcacttccaccggctccatgtccagattggtgtctctaggaaggacaatcacgcacctgaatccctcgtcctttacatggcagggcgcatagtgcagggtggttgcatatacctccaccgctgttcctgccggaaccagaaatgcttccattctggatgtgtcgtatgtgtggtcctcctcaatatcctgctgttttcccaatatcagaatcaggtcgtccacagcaatgtccacttctgaatcccggtgatattccactgcattcagtttcttgttatgtccgttgcagcatcctatctggatcggcatttgtccgtagattccattttccagctcctttgccgcaggcagggcctccatctcaggcagtgagggtatgtaaataacatcctccggtaatggcgtttgttccattgcctttaatagaccgctgaaatcataacctgtgatgatccttccataggctttaaatgccggatctgtcacctttctgactgtcatccccatgttcatacctccttacattgggccgtgcgattttccatcgacaccagcctgttttctctggtatccattataatataaacgggcaaaaaaaacgtgctgttattttacgaactaacagcacttttttgcgatcttcattcccccgccaatgacttgcggttcctctgtttttgattggcctgtttttgaatcacctgtttctgattcatctgcttacggtactggctgggcagacagccgtaccgctttttaaaggctttggcaaatgcccttgcatcggcaaacccatggtccagagcaatgtcccccacataacggtccgaattcagcaattcccgcatggcatacttaaccctcaaatccatcaggtatgtgcggtatcctgtctgagcatattccctgaacatatgggagagataggagggtgtaaagccaaacctggacgcaaccatttccaggctcagctccttatcatagttctccttcatatattgcgttacctgggacagcttatccaagtgccgtttttgctgcacccggaccttatcaatctgctcaatcctgaattctgtcacaatcagatagaggaactccataaactggctctttaccttcaggcgatagccgaattcccctttctcatacgtccggtacatggccgtgaccagggataccagcctggccttttggctctcatccttatccgcgaaggtgatacgggactcatcgctcatatatccctcaaaggatttcattgggatctgcaggacaatggtaatattggggtcagggcattcaatggaatggatttcattgggattcactatgacaaaatcattgggcttcaatgtgtattgcctggaattaataaaaaaatccagtgctccctccaacacaaggaacagctccactgactggtgccagtgcttgcttacccggtaattcccatccctcccctcgaatataaacatccgaaaaggaagatcatcattgggaatcactgtctcgtatctgaaatccatcctgcacctccatttcctgcctgtcatttacgatttacaacaacttcggcaaaccacattttaaaaaccgccatctgtattcctgcaagatcccttttgccatatttgttatgacttacacaggcctgttcagcttaaaaatcaccatggtgactgtcccctcctgcgcccttgtattgctgttaaaatacaagtacagcgtagtggtctggggcacttccacaatgagagaactggctccaaacgcactgcttctggcatttgccgtccaaaaatatatgccatattcaatgtgggagcttccattgtatacaggtgttatctgcatataaccggcatccgccagcatggatgatacctgataggatatgcagtagtatcctggagcaagcgtaatgcaggtggaatctgtcagtacaatgtttccggtggtatctgcaacccccactcccactggtatccgctgggcattattccacacaccggcaaacgtgataaaggatgcaaacacatcccctgctgcgggaccggtggctcctgttggcccggtagctcctgtcgtgccggtggctccggctggccctgtggctcctgtcgggccggtggctccggctggaccggtggctcctgtcgtgccggtggctccggctggccctgtggctcctgtcgggccggtggttccggctggcccggtcactccggcggggcctgtggctccggttggaccggccgctccggtagagcccgtggctccggtcgggccggtggctccggctgggcctgggattccggtgggtccggttggtcccggagttccggccggtccggtggctccggtcggacccgcctccccacggggaccggttgtccccaccggccccgggactccggctgcccccggtattccccgtggaccaacagtacccggatttccctgaaggccctgaggtccctggggaccggtaggccctatgaccccctgaattccctgggggccctggattcccattggcccacggggacctgtggggccggtgactcctgccgggccgatttctcctctgggaccttccggtcccatggctccgcggggtccggtatctcccttggggccctcagcgccggtatttccctgggggcccgaagctccctgagggccggccgggccctgcgctcccgtcacgcctctctcccccggtacaccctggggcccctggggaccggtgtcccccctcattcccgcagctcccatgggaccgcggagcccagcggggcctgtatctcccttggggcctgccggccccgcgggacccggacagcagcagcactccttataccagcaccctgctctctccctgaaatcctcctcattgccattccacatgttagttcccctttctgcacatattttgtaataatacattactatcaatatatgcatcagacctgcactgtttccggggtctgtaaatcaggggacttcgtatagtctgtaaagactttgtgcccggtgttttctgctcagcagttaccggcccacacataccttaaatactccctggcagtctggaccagggcatataccctggccacatctgttgcgggtctgtcatccattttccagcgcggaaaaaacctggttacatggagaggaatctccgggctcagggatgatatccagcccgccatctccctcatctcctcatccgagtcattttcccctggaacgataagcgcggtcagctccacatggcatcggcggctggcacatgtgataaaatgctttacagtttcaaggtcaccgcccagcttcctgtaataattctctgtaaatccttttaaatcaatgttcatggcatctgccacaggcaggatttcatccagtacctggtcagatacgcttccgttggtgacaattacatttttcatccctgcttttctcacaagacgccctgtatccctgacatactcccagcccaccagaggctcgttataggtataggcaacaccaatatttccgtttttcccaagctctgcagccttttgggccagctcctcaggacttacggtcacggacttaaagtccccctctcccgccatggatatctcatgattctggcagaaggggcaccgcaggttgcatccaaagcttcccaccgacaatataacagagccgggcaggaaccgtcttaaaggctttttctctatagggtccagggccatggacgtgattttcccgtaattaacaggaatcactgcgccgcctgtattcttcctggcccggcacatgccggtctgcccttcttccaggctgcaccggttcatgcatcccctgcacacagccctcatgactttgcaccgtgacggataacctcaaaacgttccagctgcacatccgtctcatcctcacctatccctgccttttgcctggcaatggacaattgtttcctcaccgtgtccactccctccagattgggaagcagcagtcccctttttctgcccttggtgacaatgacgccgtaacgcagcgggtccagctggtcctcaccctgaatctgctctgtctcccccagcacatccacgctgtattcaaggaaagacagttcctccctgcggacagacgggaatctggggtcatggatgcctgcactcactgcgttctgtatgatttcctccgcaatattcctgcaaaccggagctatcgtcccgatacagccccgcaaagcgccgcccttgcggacagatacaaacactcccgcccttgtctgaagcatttcctccggcaggccttcctctgccctgccaaagggaatcatccttccctcatgcacataatactccagcgacctgcgtgcaagagacacataatcatcatcctccatctgccgttttttacatgcttccctctgacagctttcatataattccaggaatccgcgcctgccgtcatcccctgtgacccggaatgtgcaaatcccatagcccaccccaaagggtccttcataggtgaggcgcctgggcataactgcctttttatccatggctcccgccatcatggcaaagctgcggtggccgcattcccctgccttttcgcagaagtcttccggaaaagccagcagctccccaaattccgcttttcccatgacatccatgatccgctcatcatattccggcccctggacactgtacccataaggcccgtcccctctcaatttatgggacaaatccccgctggccacaatgaatacactgcgccccagattctctgccgccctggcaatgtagcgtcctgcccggtaatggtcggcaaaggacagtccggatccgccgatccgcaccagcttataatccctgtaatgctggttgataaaatacagcgggacaagagtcccatggtccagctccttttccctctccccctctgtacccataggaaaatcgtcatccccgcagagtctgtccagttcccttacaaaggcttcgtcgtatccggcttctacccctatctgaggagccataaaccggccaaagtctcccctggcttcctttcccggcgatacatgaaaatagtccgcatacatcactgcatggggcgaaatcaccacaatggtgtccggcttcagctctgctgccatcccggccgcctcctggtatgctttaatagtatccttaatcagaatctcctgccctcttcccacatccggcacaatcaaaggcggatggggcaccatgatccccgcagccacagccataataccgctcctttccgtccggtgcgttccaccgcaccctgagatctttaacaagctctggtttaagtatagcattggaaatcctattttaaaaggggataacccacaaagaaagcacaagaagcactgccaggaacagcaggttaacagcggtaaaccaccccagataccggcctttttccatgggatacatgcgggcaatatgcttataagaaataaggctcgccatagaggcaatgagggttcccagccctcccagattcgtccccacaattaaggcactgtagtccccggaaaatccggacagcaaaagggcggcgggcacattgctgataatctggctggcgcccacacaggtgatgatttcccggccctccagaatccggcccaggaaccggcagaaagccggcacccttcccatattgccgataaatacaaaaaatgcgcagaatgtcaggaggagggaataatccactgccagaaacaggctcctgtcggcaatccacacccctgttatcacaacggccagcaaaagctgccacggaagaatgcgggccacgcaccccaggctgagcagaaagaggaacagatacaggaataagcggcctaagtaaatcctctttcctgacgcctccatacccgctgcttcctgtgaaaatccgggaaacccgctgaccataggcccctgtcccctgccattcttctcttttcccggcattctgtttcctgcagccactacggccagacaaagaaccagcatcccaaaggataccgctgtgtagggagccatcagctccataaaacggcctgcgtttaaaccggcttttgaatacagataaaggttctggggattgccgacgggcgtcagcatgcttcccagattggccgcaatggtctggagcaccaccaccggcagcactaacggttccatgccggccatcttaaggaccgcgatggcaaagggaacaaatgtgatcaacgccacatcattggtaatcgccatgctgaagaaaaaacacaggaacaccagtacggccgacacagcccccgggccctttacataacctaacagccgctcccctgcctttttaaacactcccaggctttgaagccctgccatcacggtcatcagacaaaacagaaggccgattgtcttataatcaatgtaagacccatattccctgtccggccttatgaccatggcagacagaatcgccaatataacagcagcgctcagaactgtttcccttttgacaaaccctttaaccttattcatccttcattccccgcttttacgttcataatctcacgactgcttactataccatcgaaaagcccgggaatcaatacaaaatctttaaaacttcagatccatcccccgttgatgcataccctgtcctcctcccccggtttcatccgtcattacctgactgtatcgtacactgcctgtaaccgctatgattaccggaaaacaggcataaatgtctgggattgtccgtccagcacgcccttatccgtcataatggcgcccggcagggcagccagggcaaaggtggacatcttaagcagcgagctctttcccgcgcacaggtcatacactgctttttccacctgttccacctgcggggccaggctgtcaatacacagctgggacatcagcccggcaaccggtagggccagacttgccagcacctttccattgagaaccacagctataccccctccgcttttctttaaggtctccgccgcaatccatgcatcctccgggtcccggtatatcatggtcaggttatggcagtcatgggataccgtggtggcaatggctccttccgtgattccaaaattccggatgggaacaacggtcctctggttcagtccgtgccggttgcacacacatgccatagccagattcggatcttgcctgatgcagatgtatccgtcctcaacaggcagcgcctcataaaatgccttattgaagggtccgtcatacttgctgtatatcaccagcgtctctccctgggaagcaggcgctttcagcctgaaatccccggggccggacagatagggcagtttcatggtattggtgaacttgagtcctccgtcatagggacttcccagataccttccctcttcagccacaagtttccccctgcagaacacatggctgggccgtcggccgtccagggcatccaccagctgcatatccgccacataacccggggcaatcgctccaaggtcatcaaacccatactctctggcagcgttatagctggcgtaacggatagcatctaatggatgggcaccatagcctatggccttttggaccacccggttcagatgtccttctctgtaaatcacccctgcgtggacatcatctgtgcacagggaaacactgtcatgccagcgatggtccctgattccctccagtgcatccggcagatggttggaaagagagctggtcttaaggtttacatgcatgccctgcctgactttctccctgcactcccgggcactgcggcattcatggtcgctctccggtcctgccagcaagtaggctgcaagggtatctccctccaggcggggagcatggccctgcagatacagattccgtttcaacccctgggatatgatgcggctcattctttcatcccccctgcatacatccacataattcatgatttccgcgattcccagcacctccggcagttccagaaggcgggcaatttcctcctcaccgaatacggccccgctgttctccgctccaggcacagagggtacacaggagggagccagcgcaaactggcgcaggggtgttttctttgcattgtccagcatgaagcttaccccttcaatccccagcacatttgcaatctcatgaggatccatgacaatggtagtggtcccccagggaagcacggcccttccgaaattctccggaaccatcatagtactttccacatgaagatgggagtcaataaaccctggtatcaggtaacgtcctcccccgttaaaaatccgttccgaaggcagggccggacattcattgtctgtacgcacccgcacaatgatgccgtccagtatatctacctgagccgggtaaacctccccggaaaacatgttgaccagctgtatattgcagacagtcaggtcacaggggatttctcccatagctgccctgaccatttttccacggtccatccacactgctattttcatacgatttcctcctcctcggaaacagattagataaaaaactgaatacaggtcaacagggtaaatataatggtgaaaggagatggaagcttatccattccccgctcatccgtaaacaggtagtacgcactcctcacaccacagtaagtcagaaggccgatgccaatgccctgagatatcccataaaacaaagtggatataatcagcattcctaccggaacccactcctcaatcccaaagtcaatggatttaagtccctgcatcatgacaaatccgataatgagaagtaccggcgtggtggctgcagtgggtatcatcaaaaacagaggggcgaataacacggccagcagaaaaaacagcccggtaaccacggaggccagtccggtccttcctcccacctcaatacctgatgcgctttccacatagcttgtgaccacagtcactcccatgcaggtccctacaacggacccgatggcatccaccaggaagatcttgccgataataggaaaatttccattttcatccagcatgcccatctgctgccccagccccagggcagtggccagcgtcccaaagaaatcgcttacaaaaaaagccagcacaaaagcaatgtactccggtctcaaagctcccagcacatctgctttaaaagcaatattgccaagggatgcaatccctcctgatgtgaatatggatgagggtacctggaccactcccatgggaatgccaatcacagtagtgacaacaatggcaatcagcagtgagcttctgattctgtactcttttcctcccgtcttaatgcggaggaaatacagtatgaaacatatgacaatactgacggctgacagaagcaccgaaggatcggagaaatccccgaatccccggaaatccggatttaccagcctggcattgaccagggccgtgcggatgataaaaatacccagccctgcactaatgccaatcttgatatttttagggatcagctccactatcttttcccgaatcttaaacaggctcagcaccaggaacaatatagcagaaatcatggacatgccaagacccaccttccagtcagccaaacccggcactacgatagaataagtaagcacaatgccggacgcaatcccgggagccagagcaataggcatgttggccgccacccccatcagcatggtaatacacgcggaaaccagtgctgtggcaatcagtattcccactgtgtccatccccgtatcccgcatgtttacaggctgcaggataatgatgtaggccatggtggcaaaggtggtcatcccggccagcacctcagtcctgacgctggacccccgctccctgattttaaaatgtttttccaatgtgttcatagcttcctcctttgtatttttattatttaagtttaaatttaaatcgaaataaaacccctttttttgtacaaatcagtactatgatattatggtaataccttattgacggcatgcttttatctgtgcatacaggttgatagggggctgtggaaaaattcatttctgtcacctgcagccgtcatcacaggaatgaatctttataacttaccctctcacaggccccatggattacccctccgcatgacgcaggagattaaaacggatgtggctggtatcatagagagcccccccgtgtatgacaggctcactgttctggtcgtatcccactgcctgaatcataagcacagaagctgccttaaggggacagggatgtcccagcatctctcccgcctcctgcgctgacagggaactgatttctatccagtcccgcaccaccatgcggccggtatattcctggattacctcaaaattagacttttcctgccagtccgtccgggcaggtgtttctgaaaacagatggaggggaatacgccctacactgacaatggccggaatatcgtctgccagatacagcttctccacccgtatacccctgcctccctttccggtgccaaggtgttccccaacggaggccggtatcctctcctcatccacggaaaccagcctgcactcaggccggtatccgtttccgctgataaccgaaccgaattcaagcatgccggacagattcaccttcacctgcctggcagcgggattcacaaatgttcccctgccgtgaatgcgcagaagcagcccctcctgttccaggtccgtcagggccttgcgtatggtaatacggctgaccgccagctgcctggccagttcctcctccggcggcagtttccccgcctcattaaaggctttctctgatatcagttttcgcagcgaatctttcacgctgtcactcaatgttttttttcggatgggtgctattgaaggcatattctgtttcctttctatatccggcttcacaatctgcgggcttttccgtatggttttatagtatcatggtaatacctttatgctcagtctatcatatctgttttttcttgcatatggatactttatacgaaatttccttcacaacttcaatagattacacaaaaaacaggcagcggcattctgcttcaaatgccccgcctgttcacattcctgtctgctaatccttcctcccatcggtttcggtattcccgtccccggacagtaccggcaaagtggaaccgccgaagggcattacaatcaccctggcccccggtcccatctcctttgccgccgcgtcatatgcctcctgcacatggtcaaaaggctccatgaaaatatcgcgcaccagattcctgtcaatgcctgacaccagaaatatcctggcccgttttaacgctctggcaaaggaagcagccttgtgtccgccaatctggaaatctctctgtatccgttttagtatgctgtccaggtcctctgcctccagcatccactgctcaaacacagttcctcccaatccttccggacaggcgcccgccagtatgatgatgcctccctgacgtactgcctgctccgcattggccagggccttctgtgtctgatacaggttcagatcctttggagcccctccctgggatacaatcacgatatctgccagctcattgatctccatacggtaaaatccgtccaggaacctgcatccctgtctgtgggcctccttaagctcacctgccacagcgtgaatcacatttttatgctcgtccagaaccacgttcaaaaggaaatccacgccgcagatacctgccgcctcttccaggtcctcccgcaccggattcccttcaagggttcccgcctttgccatggggtgaatcatcctgctgtggtttttccgaatggcctgcatggtggaaacgcccggcatgattgcctttgctccgcccgaataaccggcaaaaaaatggtattcaatattgcccagacatattctcagatcagcatgcgccaccttatccgctatgtccaccggtgtgccggcctttgtctctcccatatgaataaagctgcattcggacgagtccatgcatctgcaagtattatatacttcgtcccccgccagatgccgcatctcctctgacgtatgtctcctgtgggtccccatggcaaacaccacagtgatatgggagcggctgactccggccttttccagccgtttcaacacatggggaagcaccctccaggaaggcatgggacgggtgatgtcacttgtaatgatgaccacatcccttttccctgatgccatcttttcaagccgttctgtgcctatgggtgaatccagagccctctcaataatctcttcctccggcgcgcccatctcttttttatggggagtcaggatatgggcaatggcgtctccggggatttttaccttttccgtgcctgtaccataaccaagctctatctcctccacagccctgtgccgcagctcatacacatcgtttagctttaccatccctgttacctccgtatcctgtatacttcttctgcggacctcccactggctgtaggccagcataaaggcagccgcgcccttttgctcatctgagacaactgcttctcccagataataagaaacacttccatcccgttccggccggtcagccggtcccaggcctgcgcctgcgcaggttccctccaggtggaggcatccgtttctgagcttcagcttctctgtctccagagccatcatgataaggtccgcccggtggactgtctgcctgttaaatatccccatctcatatcccttataaatggaatacgctgccatggccgaggcggacgtctccagataattgcccggtgtctttcccagggccgtcagctggaaaaacagaccgctttcctggtcctgataccggagcattccctccatggcctccttccacaaaccggccaggtactgccagtcctctgacccccttggcaatatggaacagcagtctgccagggccatcagataccagccctctgcccttgaccagaaattcggggagcgccccgtctcagggtcggcccagaactggcattttccctcatcatatgcgtggatatacaggctggctgactcatcgtacaggaaccgcctggcgttttcaaactgctttatgatgtctgcgcagttctttttatcccccagctccatctcatactgaaggtaaaagggcgccgccatataaaggccgtccagccatatctggcggggatatatcttcttatgccagaaacttccggattctgtcctgggctgacgccgcaattgctccataagctgctttgctgccagccggtacttctcctgccctgtctcacgatacagaaagagcaggccgcggccggacggaatcttgtccagactgtactcctcccggtcataccaccgtatcctgccgtcagggcatatgtaccggtccagaaatacccttaccgcctctgcatagcatttcctgcccgtggccttatacatggcctccaggccggtgaggacacagccgtcctcatagttccagaacttccggtccagtttcatgaactcttgtgcatactgtctgatataccgttcagctgtcatggccctcctcttttatccgcttgataaacaatggcttgatgcctcctgcttccagaatggacatggcgtattccccgattgtttcacactggtgctgttcccctgtatccagattcttaagtacccctgccgtcatattgatttccaggttctggccgctctccacctttcctccgatacccttgcacaccagcagcggaaggcccagattgatggcgttgcggtaaaaaatccttgcaaaggattcggccaccactgcccctgctcccatgttaagcagggcaatggctgcatgctccctgctggatccgcacccgaaattagtgcccgccacaatgattcctccctttggaaattttcgggcaatcccctcatccacaccttccaggcagtggctgccgatttcctccggattggtaagggccaggtaacggcccggataaatctggtccgtgtcaatgttatttcccagggccagggcctggcctgcaaatttttccttcattttctcactcccctttcccggttgcttctgtttcccgtctctctgcctgcccctgattttcgcaggacggatcggtcagatatccggtcagcgcagacatggccacggtagccggcgatgccagatatacggcggaatccctgctccccatcctgcccggaaaattccggttggaggtggtaacgcacacctctcccgcggccaggactccctggtgggcgctgagacagggaccgcatccaggcgcggatatggtggctcccgcgtctatgagggtgtccaggaagccctttgcaatacattctttaagtacttcagcagatgccggaatcacaaccatacggacatggggggcaattgtgcgccccttcagtatgcgggcagcctctcctatatcctccacacgtccgccggtacatgctcccacaaatgcctggtcaatgcggaccctgcccgcccgggccaccgcacccacattatccacgctggagggcatggaaacctggggcttcagtccgcttatatcaaagacataggtttcctcatattcaaaatcactgtccgtctgctccaccgtaaacgggcggctggtccggcctgccacatagtctaaaaccgcctggttgggctccatgtaagctgtctttgcccccatttcaaccgccatgttgcagagcaccatgcgcccagccacatccagctgttccacataggagccggtgaactcgatagccttatacactgccccgtccgccttcattttccctatgatatacaaaatcacgtcctttggaagcacatggcttcccggcatgccttccaggtgtatccgtataatttccggcaccctgaaccagagttttccggttatcaggaccgtggccatatccgtggccccaatgcctgttcccaggcatccgaacgcgccgtgggtggtggtatgggaatcggttgccaccagaatcatgccgggatacaccaggcccgcctcaggcataacctgatggcagatacccgcgttgatatcaaaatgatgggtaagtccctgctcctgcctgaacaggcgcatctccctgtggttgcgggacgcctcaatggtgggggagggcgcatagtggtcaaacacaaaggccgccttgtccctgtcccataccttctcgcctcccatctcccggaaggaatagatggtctggagatacaggtcgttaatctccgcaaaatcaatatcggccgttatgatttccccgctgaccacccggtcacggccgctgtgctttgccaatatcttctctatcgcatgcatatccttttctcctgtcctgcttatatgattctgaatctgtccaacacactgtagtccggctcaaagccgattcccggacgttccggggccggcagcctcccctccctgtcaatctccagggagtcattgaacgcattttgccacacctcatcgtatgccggaggataatactcaatataggacacattgcccactgccgctcccagggaaacattgatggtctggtccccatggggcgccagctccagacagtgggcctgggacaaggctgctgtctttaagaactccgtaacgccgcccatgaggaaaggcgccgggtttaagattggaacagctccggtatcgatcagctccttaaagccccatttggtgtactcattctcgccggccgccaggggaatcactgtcttgtccgccagccttttcatcccgccgtaatcatgaggcgccaccggttcctccagacagtagatatcgtattcctccaccagcctggcaaactggactgccctgtggctggaatacgcacaattggcatccagcatgagcagggcccgggggcctatggcttcccgcacagcctttaccctggcagcatcttcacggatactcagggcacccaccttcatcttgacgcctgagaccccctgttccatataaccctccatctctctctggagatccgctattccttttccaggttcataatatccgccggcaatataaacaggcacgctccttctgtattcccccaagagccggtacagcggcagtcccagggacttggccttgatatcccaaagggccatgtcaataccgctgattgttctggtgctgattcccttgcgccctgttagcttaggcacatagagcctgtcccagagccactccgtccgcatgggatcctgtccaatcaaccggtctttcagctcatccaccatcatgaacggatttatgcccagtaccggaccggaaaggccgtatcctgtaatctcctggtctgtctccaccgtgatgaccgccaggccgcagtgggtgtaggtatgcattccgttggtgatgggacggcttttctcccatctgaaatattcctgttttacatctgttatcttcatatgatgtcctttacaaaagggaatgccgcaaaatgcatctccccattctgcggcattctcctcctgttccttcctgccattaccgggcagttgctgtctctatttcccggttaattccgtcaatcagcatatccgcacaggcagcagcgtcctcttccccatagctcaaagactggattgccagggtatacacaccgtcaggcgcctttaatgcagcccgctctgtgaatatatccagcttgaaagcagaccatgccatcagtttctcattcatttcagccaccaggcttccctcagtctcaacatatttaaccgcattcttgttgcacgggatgccgcggctgtccccaaggataacagctccttcttcgtccccaaacaggaactgtatcagggcagctgcttccaccggatgctcagaagtggaagtgattgcaatgacctgtgatgccttgatgggaccgccatggtattcgcccatattaatcatatcgcctaccacaatttcgccgtcagtgaccgcatccacatacttggcaatattggtatcccagcacatggcgccgccgtaatgaccgttaatccagctctcgcttgtctccaaaagttcagaggtgccttcccctgccagtttttcggaatcagggatgatgtgcctgtcttccagctccttgatgaagttcagtccttctgtgatttcttccttggagtactgaagcgcattgtccttaatccaatccctgccgtatttacactggagataataaatcatgagatgcacctttacataatccgcacaggcaaagggatagtaggatccatcctcataagccgcgaatttctcccctgcctcatacagctcgtccagggtagtgggtatctttgctcctaccttatcataggttgtcttgttccatataaaaccgcggcccgtattggcgatggggagggcctgcagggctccgttcaccgtataaaaggccttgtcggaatcatcataattagacaagtcaatgatattggaaaccttgttcagatcataaaaggtatctccgttgggtgagtaggcaaaaacccagtccatgttcagctgtaccacatctgccgcggatcccgcattaagggccagggatatcttctcctcatggccgttaaaagcctcgtactccgcctccacggttatgttgggatatttggcctcaaatgcctcgatggccttaagtgtcttttcatggcgggaatcccctccccaccagttaaaacgcagggtgattgggtctgtggtgtttacctccatgtcagcaggagctgccgcctctgtgtctgccccggctgcttccgggtctgctcctgctgcgttttccgcctcctttgtatcctgggtcttagccggagcggctgcggtctcctttgactgtgtgggcatacatcccaccagggaccctgccagggcacccgccagaatcagactaaccagttgttttcctcgttttctcatgtgtaacctcccattataattttatttatttttctttacccctttactccgcctgccgcaattccgtctacaaacgaatcctgcgccataaaaaatacggccagggacgggataattgccagcagcgacattgccagtatccggttccagtcaaatcccgtctctgtatccatggacattctcaaaaatatggataccggatatttgcgcactgaattaatataaatcaacggccccatgaaatcgttggaggcccacataaactggaacagggcgcatgaaacgatggacggcttcagcatgggaacaatcacgtaccacagcctctcaaccacattacatccgtcaatctccgcagcttcttccagttccctgggaatcccccttaaaaactgtatcagcatatatacaaagaacgtatcccctgccagcatggaaggaatcacaatcggcagataggaattcagccaccccacttcgttaaacaggatgtactgaggtacatttaagaccacctgtggcagaaacaatgtggagagcagcagcataaacagcagatttttgcccacaaaccggaacctggcaaagccataggatgtgatgaccgcagagatcacggtgaacaccactttcggcagtacgaacttgtatgtattccccataaaatgcagcaggttcatgccctcgtaacccttaaacccgtttctgtacccgtccagagtaggggccatgggaatgatccccgcactggaaaacagctctgaatttgtcttaaaggacgctccgatcatccagcacaggggatatatcatcacgattcccaggccaatcagcaggagataccgcaaaaacaggttgagacgtgctttttcttttctgttcatatgccctacctcccatcctcgtccgcatagtaaacccaatacttctggctgatgaacgccaccgccgtaaaggtcatgattaccaggaaaagcagccatgcaatggcgctggccagccccatctcattccgtttaaaagcttcgttatagaccagcagcgacaccagggtggtggagcgcagcggacctccctgggtcacgatgaagggaccgttaaattcctggaatttatggcacagctgggtcacgaagttataaaaaataacaggtgtgattaacggaaccgtgatttggaagaactgcttccattttcccgctccgtcaatggccgctgcctcgtaaagatctccctgcacccctttcagggccgccaaaaagatgaccatgggagaaccaaactgccacaccctcagaagcacgattacaaaaaatgccccatcgggattacccagccagttaaaggcaggaatccccagcgccccgagcatgatgtttacaaggccctctgtcttgaacaaaaacttccacaggaccgcaatggacacagatcctcccagtatggagggaatgtaataaatggtcctgaaaaaattgagtccccgtatcttattgttgagtatgtaggcaataaacagggcgaacataagctccagcggcaccgttaaaaacgcgtacttaaaggtctgtataaatgccttgatgatcagcttatccccaaggatgtacttgtaattttccagcccggtaaaggaggctgtcttgaacaaattgtaggaatggaagctgtaaataaaggaggccgcaaagggatacagcttaaataccagcagtccaatcagccagggcatgacaaaggccagtcctatattgcgtttccagaatcccttcttcttttttttcattcttatcccccatacgtttatttccatccggccggaaggtaacgttctgtattgtgaatcatgtcatctgccagtttccttatctccctctcatcccggcatttgtgcttcaccagcggatcattcataaatgccttcaccaccagattccggtcatatgtatctgctgcctccagtatgtatccgtgattctgtacatgcggaagtatcaattccctgattggttccggcaggggaccggctgccactgccctgatgctgtcacgggagaatactgcatttgtctccaccacagcctcctttggaagattgggaatctgcaggaagctgtttggcatattgacattgctcaccatccggtccagacccaccagagcctttatctgctgtaccccctcctcaccggacggaacaatctccatctgctcctctccttgaataaggcgctttctcctggccaggcgttcctccatctgactgattctaaagtctactgtggtcagcccgaacttccatgacctgactgtctccgggtcattgagataggtgtttcccggcatgaactctgccagatgccggtctcctgcggcggcgatcagtccataacggttaaacaaatcaaatttcaccctgtgccggcagttaaaggtggatttttcccatggacggtcaggatcgtcatagccctcctcaaaatgtgtcccaatgtacttcttatagacggggaacaggtccgcgccttcataagaagcagcgtcaaaccaggtaaaatggttgattcccaatacatttacatggatatccttacggtcaatggggcctgtccccagctcctgcgaagcaatggcggccagcaccttctgtgtgccgaacacctcatggcagcagccaaaggccttgatttcaggaaatgtcttatagagactggccacgcacaggctcatggggttggtatagctgatgacccatgcaaggggacaaaactctctgatagccagcgcaatctcctcatacatgggcagggtgcgaagggcgcggaccataccgcccggacccgccgtatcccccaccgactggtagatgcccagccgttccggcaggtgtacatcagaacgcatttcctcaaaggtgcccggcagtatggagattaccacaaagtcagcgccctttaacgcctcctttaaggaatatgccaccttataatcccaccggcctgcggcctcctttctctccttaagctgactgccgatgatctggttctcctcagccgccctggcatctatatcatagagccagaccgtcccgtccagcgcaggctccagggccaaatccgccatcagcttccacgcccatgccttggatccccctcctatgtaagccatcttgatgtctgatacatgatgattgttccacttcattcccatatcctcctcgttatgagcacttggcgtctgtctttcagacgcttacgtgcgatacatgccgcccactctgaatatcgtatatcgtatacgatttactgtagttttatcatacttccgatgaaatttcaattacttttgtatattatttttattttttggctaatatcactaatttttatgtgcactttttcatttacaagcgcaactaagttttgactcttttgggtttgtatgctaaaatagctttattctaagaaaagcgggtgaaacaaatgaaaaagctggattcgctggaaataatgcccacgcgcatccgaatcgcttccattcttcgcaaggcgattctgtcaggcgagtttaaagaaggggaagaattgtcccttacagacatagccaataacctgggtgtcagcaggacgccggtccgtgaagcatttcagattctctcctccgaaaatctgattctgctgagaatgaataaaggggcgattgtaaaaggaatcaccaccaaaacaatccgtgagcattttgagatgagatcattattagaaggggaggccgctgtcagggccaccctgagacattttgacgtatcggaactgatggaatcccaggtccacatcgaaagcctgggagaagatttcacagatgacgagtatcagtcctataaccagaatctccatacttccatatggaaggctgccgacaacagtaagatgtattccaccctctcctcactgtggaatggaagttcctttggaaaaaccgtttcagccaaggaccatcagattctctccatcagggaacacaggaacatcctggaatacatccagtcctgcaatccctatctggtgcgaaaggaaatggagcaccacattgaacgaagcatgaacaatatcattgacagcttctccttaaaggaaaacgagtaagaaaaagaaaacgtaagccctccggcgcacaaaaaaccgggccgcagcatctgctgcggacccggttctttatatgtagaaatcaaggaaagtgtatctgatatctgactatgctgcaaatggagcgatttcctccatcagctggtcacagtcatctgtgtgaagaatcagttctacagttttggactttgccagtgataatacacctacaatagactttgcatcaaccatacggctgccgcatttcacatctgcatcgcactcaaaacggttcatgattcttacaaaattgataatctgatctgcctggtcaaacttaacaaggatacgtttcatgttgttcacctccgtatggtattttatttagtttcactgtcagatacttgggggatggtacttactggtaagtccgcatctgacaatgcctgctaacgttatcttttgtttgtcttccgacatatttataataccacgttcaggtactggatttccatggtaatatttttctatctcatggaatattttcaaatattatccttatctcatctaaatctggtccttccagtaaccaatattttccgaatccacctttatgggctccccggctatgacctccagccccccgtcatgaccgtaatccatggggtatgtccggcctcccagaagcagctcctggtcccccctctcctcaatacggccctcagacagctccaggcacacataccctgccacccttcccaggtccatggggttccatatataaagtaccgggcagatatcctcaggatcgctgcccacatactcctccatctggtccggaagtcccaggccgatgacctttacctttgaggcctggccccgcgccttcaccacatcagccgctgccttgattccttctgtggacaggcagcacattaccttcaggtcaggataagtctccagcatcagatttgccttctcagccgccttttcatattccccttccccgtaggcaatgtccaccagacgcaggtcacggtactccaggttctgcagctcctgcttcatcatgtatatccactcgttttgattggcggaacggcttcccgccgacaggatgccccactggccgctgtgaccgcatatacggtccacctccctgaccagttccttgcccagctccctggcatccaccgggcttatgtaaatactgcggcttcccgcctccacatccgcatccagggtgatgacggagattcccttttccctggcctgggtcaggaccggagtcagggcatattcatcgttggcagccacggcaatggcctccaccttctcgtcgataaggttctgtatcagatgtatctgctcctgggcagagggatggtcggggtacagcacaatacagttcttgccggcatcctccaccgcctgtttaaaaccctcgctggccagctcattgtaccagttgttcctggatttcatgataatggcgtattttcccctgttaaactggctgttctggcaggaaaacaggaacaacatgcctgccatcatgaccgcccccgctatccaagcccaattttttcctttcaccctgccgttcccgccttcctgctgttttttcccagtatatacctaatgtcgtattttgtccatttccgttgcaaatttatgatttcttgatacaatagttgtatcggtattgattattgtatacaaatcactgccttttagaaaaggatggatgatgatagatgaaacttctgattgttgatgatgaaaaactgacccgtgagggaatccgggacagcctgggcctggagagccttggcatcagccaggtactgttggaggacgacggcatacacggccttaaaaccgcccttgaggagcgcccggatattgtgctcacagacgtccggatgcccaggatgaacggggtccagatggcggaacggattttaaaggagctgcccgggaccagtatcatctttatgagcgcttattccgacaaggaatacctgaaagccgctatcaaactgaaggctttgggatatgtggaaaaaccccttgacatggaggaactggcctcagccgtaaaggaggccgtggacagcagcaggaacgagaaaataagccaggcagcagcaaggcttcaggaaaaggaacagctgggccatctgagtctcctgctgtcccagcccggggaggaaagtcttatgaaggcaggacagctggcagcggacctggggcttcccatcacccattccacctgcttctgctgcattatcattgactgtgtcactcccttatccgcactgccggaggatcagatggacggcatcagggattattttatggagtatctcacatccatggacatatcccaggcctatgtgctgaggggggaccaccgcattattgttttcctccactccccggagcgtcccgcggacaagacactgtacgactgcgccgggcttctggcccaaaagcttattaaggtatgcccatttttcatttcccttggcccggttgtaagcggaatggaccgcgcgcacatatcttaccaggaagccagcgaacatctgaaggaggcatttttccacgactacggattcatactgacccgcaatatggaaacagctgttttccggccgccggcagatctccttctggaattttccatggccctgtccgaaaagcaggaggaggaagccctggacatcgtcaggcggctgtatgaatcctttgtgccaaacgacatgattggccccagccaggtaaaggatatctattacaagtatttcagcaagctggacgaacacggcctgggaagctatatatccctgtggcagaaggaaggactggagtctgaatccatctgggagggggtcatgaactgtaccatcctcagggagctcaatgaccttctggcggcaaaggtgcgcctgttctttgagcgcctgcggggaaacagcgtgggaaatccggtggtattccagataaaggaatacatccataagaactatgcggtcccgtccctttccgtgcccgatgtcagtgaatacgtccgcctttcatccagctacgtatgtactattttcaagaatgagacaggccagaccttaaaccagtatctgacggattaccgcatcaagatgtccaagcagtttttaagcgaccccagatacaagattgccgatatttcctccaaggtaggatacagcgacggcaattactacagcaagacctttaagaaaatcgtgggcctgtccccttctgaatacagggagaaaatgcttgcatgaaaaacccattcacaaagctgattcaccattatacctatgacatgcgccttaagacaaagcttgtcatatcacacatcatcctggttctgctgcccaccgccgtactgtcaggctttctctacctgcgcatttacggcattgtcatggatgacagcatacgctcggagcaggctctgtccgcccagaccgtaacctccattgagaaccttgtctcccatgtaggacacgcttctgacaccatcaccggcgccatgatggtacaggacctgttccaggtccccaggtcagaggccaataccctggatatctccacctcccggatgaacagcctgttccacctggtgcagagcattacggaccattccatgattatggatgtgaaaatttattatgatgacagcgtgtatggggatctgatgcagtacaacaagatagggaatgccctgtttaacccggtttcttccatcagcagcagctactggtacggaatcttcagcacttcggagcagacacgcctgctgtgcccggaactgtacctgacgccggatgagacagggaagaacggaaagctggcctacattacccgaatcccttatatccgtgacagcggcactgtgccagacgctgaaaacgcctccgcctatgtggccctgtatctgtccaggcctgcctttgacatggtgctgcgcaatgacgccacggtcacggacgaggccgcctttctggtaaatgagcgggatgtgatcgtgtccgcctcagatatgggcctggccgggaaatacttcattccccgctcggatcttgagcagcggatagggaaggaaaagacgttttcccttgtctcctatctggacggttccgcttatgttgcctattttcccatagcggacacggactggtatatgatgtccattattcctgccctccatatcgcagatgcaggcagggcgctgatgatgcattttgccctgatttacctgctgttcactgccctggccctgtacactgccttccgtttgtcgggttccattgcggaccgcatcataagcgtggccctgcagatggaaaccgtgcgcacagggccgccccagcccatggatgtggctgacacgggctgcgacgagattggcgtgctatccgatacctacaactacatgacagaagaaatcatcagcctgatggacagccagaaaaaggcttcggatgagcttcggatggcggaattccgcgcccttcaggcccagattaatccgcattttctctataataccctggatatgattaactggctgtcccagaccgggcagagcgagaaagtaacggaagcagtccagatcctgtcccgtttttataaactgactctgagccgcagggagctgatgaactccatcgagaaggagctggagcatgtaagcctttatgtgcgtctccagaacatgcggtatgacaattgcgtggcctttgtggtggatgtgccggaggaactctgcgagtacacaatccccaagctgacgttccagcccattgtggaaaatgcctttctccacggaatcatgatgaaggaagaaaaaaaaggcagtatcctgctaaccggctggccagagggggatgatattgtattcatcatctctgacgacggggcaggcataccgcctgaaacacttgatactttaaaggatgatgtgattgccggtaccggctcctccgccagccccaggcacactgctttttccggccatatcggcatctacaataccaacttaaggctgaagagcctgtacggcgaatcctacggcctatccatcaccagcacactgggcaaaggcacggaggttaccgttcggctccctgccagacatatcacgtctgactgatgccttttacatcccagcaatatgattcataggccgctgtcaggttcatggcagcggtctcttttgccgcctttttctccagataggatgcctggccctccaggtactgtgtgcctgtcagcagtccggcctgctgctttctctggagtccttcgtaggccagctgagcgctctgaaaggcagtgagagccgcctcataggctgtcttactggcctggaggttctggtaggaagccaaaaacgctgcctcctttgtcccctcagcctcatccaccagcctgaatctgatattaatttcagtggtactgctggctgaggtgtggcgggcattctgcacactcttgtcatttcccatggccctgatcttatcgctctcatagtccacggcttcaatggcggccatatccggctccggtacagttcctatgaccacctggctgctgtcctcaatccccagcatggtaagaagctgctgccgcagctgactggcctggagcctgagggattccagcgaatttttggcagtgtccaggtttttttgcgcttccttcagctgggcctgggtggcggaacccgctgcctgctttctccccatggcctcaaaggcggcctgtaaggactcaacccgcttttcctggtattccacgttctgcaccatctggttgtaggaattcatcagcgtctgggctgtcatggtaaaggtatccgcggatttttccaggctgcgggtgctcttttcactggtcatggtatccagctggctgtatatacggctggccgaggattttaacatggcggcattggaggaatagattatggctgtctgactgtcctcatcgtccatgtcctccgccttatcctccatattgtcctgctcccgcttaagggtgtcccatatttcctggtaggcgtttacattgtcctcgtaatcctctatgctctctttcaaagacaggttcccctgtttcagcagttccctcagattgccgtattcaatgattatggcacccgctgtattccctgcggtttccggggtggtgctggcggcttcggcctgggatatatcctgagatgtgtcctgagatgcataggaagtccggcccccggctccccacaggcacagtaccattgccagaagaactattttagccttttgggtgtttcctgttagcgtgtttcccgtttctgtgtttcccatttctgaatttcccgttattatgttccccctgttcctgccgctctcctttatatcactgcggtttctcatttctgtcccacctcgtttcgttctgccatttcctgtgctttacacggttcttttccgtctcccatattctcacatcctatgacacggacgccagtccgtccaccgaccaacggtattccaactgggccttaagcagggccagcttctgtgtgcgcacattgacctgggccgcggcaaaggcggtctgctgcgttacataatcattccttgttatggtcccggctgccattttccgctccgccgtctccatggctgccgcctcaatttcatatgcattgagggcctgctcgtaatcggatttagatatcatcatgctctcgtatgcattttttatgctggaagcggctgtctccttctggctctttaagctctgttccagactggttttgttggtgccgctttttgcattggctattttcttttcaagtattttaaggctgtagttattttccactcccctggatacatcctcatccaggttaatggctgccatcccctccaggtccggctccggcacatctcctatatccacctgcgctccgtaggtccatcccagcataaggcagagagtttcttttgtctgccccagactgctctgggccgacagcagggaggcatctgccgatgtgacggcctcccgggccgacagcacctgggcctgggtggacatacccgcactcaggcggttaagcgtctggtcataggaggactgggcctgtatcttattctgttccaggctctccagactgtatgtctggctccagtagcttatcatcagctcctgggcctccttcaccagacctgcctctgtcttgtcatattccagctttttgacgtccccgtcctccacattgtcgtctccctgctcccgcagattatctgcctgaatctggctgctcaaataggaggaaaggcggctggcataatctgaatccgacgaatcaggatattccaggcttccgtatatatcatcggcggcatcatagtaatcatccgcgatatcgtccgcgtcctcgccccggaaatcctcatactccagctggttctgaatcaccgtgttattgtatacatgaatcaaatccgctatctcagtgaattccagctgattatccctgagggaagcccactgttctgcggtataggcaaactccggggtgccggcccatgccgtcaccggcatggtgccaaggcacaataccactgccaggcatcctgcccctatctttccatatttcatatgattgacacctctttcttaaatatccagtacaacccgtttcttatcaccgttcataagcgcatagtagattggcagtatgaacagggccaccgccacgcccacgctgagtccgccgatgttaacaatggccaggccctgggtggtggaaccgctgtcccctatggccagggccatgggaatcatggaaaggatggtggtaaggctggtcatcataatgggccttaaacgtgtggcgccggcctcaatgagggctgtctttaaatccatggtcattcggtattggttcactgtatccacatagaggataccattgttaacaacagtgccgaccagaatcaggaagcccaggatagacgtcatactgatgctgacccccgtaatctgcaaaaggccgaaggagccaatgaggctgaatggtatggtagtcattaccatgaaggaaaacttcggtgactcaaactgcgctgacagtaccacaaataccaggaacacagcaacggcaatcgcctggtacaaggctgcaaactcctcctgcatcattcggttcatggagttgacgccccttttgatggtgccgcttaagttggggtttatgacctcgctgtctatggcggactggacatttccccctgtataatctgctgtaatggttatctcatatgccttatctgtcttggaaatggaagccgggctgtccttataatagatttccgccacatctgtcagggccacatagcctccggaaggcttggagagtataatatccttcatctggctgaccgtacggtactcatcctccgggtactcagccatcacgctgacctccctgccgtccacatccagggtggtcacctcttcgccgtccatcatctgctttacctgggaaccaatctgggatgcagtaagcccctccgctgccgccagtaccgggtccaccttcacggtaaccacaggcgctgtattttctatactggaatggacgttcatcacatcgtccctggccgtcatctcggcaacaatcttgttgctgacttcctggagctcgtcgtaatctgttccgttaaggatgacttcatatccccggttcctgctcatgaagctcatggacgaggatgcctccactgtcaccgtacaattatccagatccgccatctctgtctcccactgctccactacctcatcggtgctcatatccctgttatccctcagataggctgttatggtaccgctgtcattgttatagcgcagcatgtaggattccacatccggatgctcctggacaatctcctctgcctgcagcagcatggcatcggcattttccgacagcagccccggccttgtttcgatggaaacgctgaccgttcccgtgtcgtccgcggtcataagttcggtttccatcccgctggccagaaaataggctgcaatcaccaggattacagatgcaatcatgataatggccttgtggtttaaaagtccgggcatgatgcggcggtatccgttctgtatccgctccatgggccgcgacatcggcgcctgcatcctctcctggggcttatacgccatatatgtaaggggaacaatggtaatagccgacaaaaaggaggcgagcatacagaacacgataacgtatcccatggagccgaacatctgtcccgacataccctgcagaaataccaggggcaggaaaaccacgcaggtagtcaccgtggagcctaaaatggactgcagcacaatgtttgtacctgacagggaagccctggcatatcccagaaggcccttgtcctcctctgtctcgatggccctgaaacagctttccagcaccacgatggagttatccaccatcatgcccacgcccagcaccagaccgctcatggtaatgatgttcagggaaaaaccggcgctggtcatcagaatcagggacaccaggatagaggtaggtatggagcttcctacaatcagggacgccttataatccccaaagaaaatgaatatgataatcatggaaatcacggcagccagcaccagggtaagagccacatccttaagggagctgagaatgctgtccgcgctgtccctgacaatcctgatattcaggttctcgtcgtccgcctccaggctttcgataacttcctggacctcggatgacacatccatggccgtgctgctctgctgcttggtgatggaaatggaaatagtgtcctggccgttgtagcgagagatacctccccggctctcctctgcctcataaaccctggcaatgtcctccagatacacaatttttccgctggaggtggtgatggggacttccttcagagcttctatggtctcatgctccagggacgttgacacagaaagctccagttttccggatacagcatcgccggatgggtaggaaagatttgccgtgctcatagcagtggacacgtcgctcatggtcacctgatactgggccatctcgtcggattgaagttcaattttataatattccgacttaccgcccatggcctccacctctgccacagaggaaatctgttccagcaaaggcaccacggtctggtccacataatcgtataaatcctcctgggaaggatttgatatggaaagcatcatggtggttcccgcattgttattcatctccatgacagaggtctccgcgtcgtcagggagctggcggctcaatgcatccagactctgggataaatcattatatgcgtcatccatatcggtgccgtaatcatattccagcataatcatggccctgttttcgctggaagtggagctcatgcttttcacgccctctatggtccccacctggtcttctatgggctgggtcacaagttcatctatatcctcgggaccagccccggaataagacgctatgataatcagcatgggctgatccgtgtccggcatctgttccagcgtggcattaaatacagaagaaataccgaataccagaaggcaaagcaatgccataaccgtggccaccggacgttttaatacaaaccttgtcaatcccatgggttatgcctcctgttccgcctgtgatgctgcatgtttgctgtcttccccgccgggtgctgctgtttctccggcctgtgtttcttcctcggactggttcccttctccgaactgaaactcttctccggactggtttttctctccggcctgtgtttcttctctaaactgtgcctcttctcctggctgcacctcatccctcaaccgtattttcgccccctcatacaggttggagctccatgtgctcaccaccatgtcatcggctgacaggccggaaagaatctgggcatgttcctcatcctccagtcccacttccacctgggccatggatgcggtgccgtcctggtacagataaacataggcattgcccccgctgtaatagatggcatcaatgggaaccaccattgtatccagtgcccgttccgtcacaaggtttaatttcaccgtgcttccggcggcaatctcctgtgtgctttcaatctgggcctttaccttaaacagccccgtatccctgtcaaccatggagttgatttcactgatatatgccttgtatgtagttccgttcttctggatttccagctcgtcgcccacattggcgttctgcatcatgcgctgggtcacatagaaggagactatgttctcaccctcgccggcaatcacacataaatcctgggactggctcaccctgtcgtacacctccacgtcaaagctttcaatctttccattgataggagcggtgacggaactgtactgtacctgtctttcgtaagccagtttagcggactcatactggagctgcgcggatttcaccgcattgacgtactgctcgtattcctgctcggacaaatcgccgccgctgtaaagaatctgcattcttctcaggttgctctgggcctctgaaagggatacggatgcagcatccatggagttctttgccgtctccacctgctctgtatcaatctcaaacaggacctggccctgtgtcaccatgtcccctgccttcacatataccgccgtgacatcccctgctgcctttgcatagatatgaaccacatcagaaggctccacagtaccggtaagccctgtggtaaggataatattgccggaggacggctgttctgccctcaccactgtgacagaagcctcctgtcccataggcatgccgccccttgctttttttcctcccttcattacaatcatagccacagccagtatgacaatgattccggctgcaatgcctatctttattttcctgctcttgctcatatccaatctcctttgctggtttactcaactgattcctaatattaaaggttgaagattaattcaacattaacaaaacaggtatgaatgtcatttatttcacgtgattctgtgaattttttgtgactttacctgatgtctgatgcaacagcataagctgtccgaaaacagaactaaaagacaggcaggtacacacatccggtacctgcctgtcttttagttctgtttggacttgcgatggaggcgatgacagccaatgtaaattaaactgctccattgacgccggcatccctcttaatcattttttcataagcatatttgacactgttatcaaaccatatggttccgcagtagtcaaaaccgttcttttccaagacatgcctcataatagcatttttctcatcggtgtcaacccgaacgctgtaaattcctttttgaatacacagctcttcaatgagctgaaacgcaatacttgctataccatgcccccggtaagccccggatattgccatacggtggactaccgcatagggaagatcgcttttccagctgccctgcagcgtttcataggacgcctcgcccgcaaaatcaatgcagaggtatgccgcagcgctagaaccctccccgataaaatatccccgcccatgcgccaggtctccgatgatggtttccatatccgggtatccggtctgccactggtcaatgccctgcgattttaaaaactctttggcttcatcgatcaacgccattgctttctctgcttctttcctatctgctggctgtaaaataaatcgttccatacgttgtacctccgtctttttgtttttgaatctcctgaattttcgttccgcaaaaccatgtggcaaggaaaccagctttgacaaatcgcacttgccctctttcctcttgtctgctataataacacaaaacaatgcagcgaacaaatcaaagtatttatatatatagttcaatttttttgaagtattggaggaaagcccatggagcttaaatgtttaagaacattccgcacaattattgatgaaggcggtttttccaaagctgccaaaaagctgaattatacacagtctaccattacgtttcaaatgaatcagcttgaacgcgacttatccacaactttatttgaaaaaatcggcagaaaaatggttttgacaaaagcaggagagcatctgattccttatgtggatgacattctccagtccgtggacaagttatcttttttaggcgaacatttatcagaatgccagggagatatccagatcggtgttggcgaaagtctgctatgctacaagctccccgctattttaaaggaatttcacaggcaggctccgaaagcccgtttgttcctgcgctctatgaactgttatgatattcgggatgagcttttcagcgggggattggatttaggcgtattttatgaggatgtgggaggctttggctcgaatcttgcggttaagccttttggtaattatcccgtggttttggtggcatcccccgaaatccaaaacagatacccggattttgtgacaccggacagaaccattccgctcccactcatcatcaatgaaccgaactgcattttccggcagatttttgaacaatatcttcgtgataaatcaattattctcgaccataccattgagctgtggagcattcccacaatcaaaaatcttgtcaaaaacaatgtgggcatttcctttctccccgaatttacagtcacagaggaattaaaccgtggtgaattggtgaaaattccaactgatatttcaggcacaaaaatcactgccgtctgcgcgcaccataaaaacaagtgggtcagtccgctcatgcagctgtttatccatttatgtgattcagtttcctgcggcggggagcggtaaccggcctctctgcgtctggtatcgcgactgtaaagcatataaaatcctaaataaaaaaataaatattctttcattttctgatgattcgtttatgtttactttataaaaaggtgttatatatgtataatgaaatgtagcagagggaggtaatggaacatgtttcagatactggttgcggaagatgacaagaatacccggcggctgatggaagctgtactgaaggaacacggctaccatcccatcctggcatgcgacggcctggaggccttgaaattattagatactcaccatgtggacctggttatactggacatcatgatgcccggcatggacggctatgagttcaccagacagctgagggctacagattacaccctgcccattctcatggtcaccgccaagcagctgccggaggacaaacggaagggattcatcgttggaacagatgattatatgacaaagcccgtggatgaagaggagatgattctgcgcatccgggcccttctgcgcagggcccagattgtgaacgagcggcgcatcaccatcgcagatgtgtgcctggattacgactccctgaccgtaagccgaggggatgaaagccagacgctgccccgcaaggaattctatcttctttacaagctcctgtcctatcccggcaagatattcacccgtatccagctcatggatgagatatggggcatggaatcccagtcggacgacaataccatcaatgtacacattaaccggcttcgcaagcgttttgaggattatcccgagtttaccattgaaaccatacgcggcctgggctacaaggcggtgaaacatctatgagacacaggagaaaccgtaaaccactgggtaccatgaccctcatactgaccgcaggtatcttcttaatcatgctcactgtcatgaccctgcagggatttttgatgtacctgtactggaggattttctaccaggctgatattcccatcccccagttctggcgccccattcccctgctggccgtgctcagcgccgtggttggcgccggcctcaccctgctcttaagccgcatccccctcaaacccatccgcgacctgattgaggccatcaaccagctggcggacggcaacttcaaggtgcgcatccacctggacctgaaccgtgaatttgaacgcctctccgaaagttttaaccgcatggcccaggaactggagaacacggagctgctgcgctctgacttcatcaataatttttcccatgaattcaagactcccatcgtatccctgagaggctttgccaagatactgaaaaatgacagcctcacaaaggaggaacgggacgaatatctggatatcatcataagtgaatccaaccgcctgtcccagctctccaccaatgtgctgaatctgtccaagatagaaaaaatgagcatcctgtccgatatggaatcctttgacctgtcggaagaagtgcgccagtctgtcctgctgctggaatcaaaatggcagaaaaagaacctggaactgtttattgatatggatgaactggaataccacggaaataaggcgctcctaaaccaggtatggattaacctgattgacaacgccatcaaattttcccctcagaacggaaagataaaactgaagctgcacaggaagaaagaccaggtggttttccagattctggacaatggatgcggcatggatgaggagacaaagaaccacatatttgaccgtttctaccagggagacagttcccatactgcggagggtaacggcattggcctcacggtggtggaaaaaatcgtacacctccacaaaggtcagatccgtgtcatcagcgaggccggtatcggtaccacctttacggtgaaccttcctattatcccgccctcttccgttctgtaagtttctgtgaatttttccggcgatttttccggtgatgttctatgtgaatttccccggcgtgtatatcgccataaattctgccatgagtttccccggtaaattttctttgacataccgcacattttctgatatgatgactttactttacaaaagccactgcacgaagcccggaaagaacccgctaagtgccggtgacatgtatcgcatggaagcgtctgaaagacaggcgccaagtgttcataacaaggagggcgtttgatgtatttatccattcgtttaagataagcagcaattaaataaaacctgatatggtttttttgttgtgcctgttttacggatgagatgcagatacgcctgatatatttttatgtaatatgtgaattgcccgccgctgatccgggggacagtttgttttctacatacaggcatggcagatagaaccgtaatggctttatctgccttttcatgttgtatttatattgtatttatgctgtatgtatgctctatacagccaaaacaggctttgggacaaacccaaaaacaggacgccatgtcaggtctgatacagaatatggaaaggattttttaatatgaatgattattcaagatggaaacagaaatttctgaccattgcagcaggccagactgtctcccttatcggaagctctgctgtccagttctcgctgatttggtggctggccagcgaaaccggctctcccatgatgatggcgttatccggcctggtggcatttctgccccaaatcttcctgggtccctttgccggggtgtggattgaccgcctgaaacggaaacatgtggccattgcagcggatatgttcatcggcctgatagccgtggtctttgctgtcctcctgtgggtgggccatcctccctactggtctgcctgcgcggttctgggcattcgggccctgggaagtgtattccatacacctgccatccagtccatcgtgccgcagctggtaccgccggacaagctggtccgggccaatggctggaaccagttcatgcagtccggcgcctttatgctgggacctgtcataggagctgccatgtatgccgcgctgccgcttccggtcatcctgctgactgattttataggcgcatgtgctgccagccttacaatggcggtggtaaccatccctgaaccggaacacagccatcaggaggcccctcatttaatccgggaaatgaaggaggggcttagcatctgcatgagcgaccgcaggctgatgaagctgactgcggccgcagccattaccatggtattttatctgcccctggcctcctattatccgctgatgtccagcacttattttaaggccagtgcatggcatggaagcgcggtggaattcctctatgcccttggcatgatggtatccgccatcatattcggcagcctgggcaaggtaaacaataaactgaaggcatcctacctggggctggccggaagcggcatcacctgctttatctgcggcatcctgccctctgatatgtgggcctggtatgtatttgcagtgacctgcatgttcatgggcggggccggcagcgcctacaacattccgtttgtggcctatctgcaggagaatatacctgcagaggcccaggggcgggccttctctcttttgggaagcctcatgtccttagccatgcctgtgggccttctcatatccagccctgtagcccagattttcggggtaaatatgtggtttttggtatcgggaatcggtattctggctgtggtggctgtatgctggctttcaggaaatgattaggggaaggcttatctttgtcaggaaaaaaccggcttcccggccgctgtaaaaacttccgccatggtccccaatgattttagcgcaggtcttaaggccgattccggtgctctccttttcctgcgcgtcctctgccacataattgccaaaacagatgataagacaatccgcccgctgctgataggatacggttaccgggcggttcctgtctgcgtatttgagcagattggaaaatatatttccgaatacccggcggcacagattaatgtccgccaaaagcctgcaattgatttcatcggaactgcgcctgatgtcaaagccctcgctctccatgtcaaagaggctctcctccacgatttggcccaggaattcagccccattaacctcctctgcctcaagctcttccctttttcttccataaacaataaaatattcaaacaatttatctgaaagttcctttatctggtatgccttatcccgaatggaattcagatactttctccgctgcccccggtcttcccctttctccatctgaagtatgtccacataacctaacagagacgtcagaggagtgcgcagatcatgtgacatggcagtgaccagttcacggttggcctttcccgcttcctcctctttctgctgccgttccttgatggcacagcgcatggcatcaatttccgctgccagggaggcaagctcatccttcccctttaccgtaatccggtaatccaggtccccgccttttaatatctgtatctcctgttccatcaaatctatgtacctgatttttccgcgaatcagcatgaccagcatcagcgcaaacactgccatggaaatcacgcctcccagcacgctggcggcagcataatatccatattccgcataatagctgactcctgcctgggcagtcccgtccgcaaatttcacctcataaagccatgaggtatcttcccactcattcatttccggaaccatcaccatcaccttggcgtcattgctgtaccgaaacctgccgtctttatagatggttatgagaaggttcttttctcccgacgcccacttgtccagcattttaccgccattcgtggacagtccgttctctgtcacatacgcctgaagccgctccacgcaggcctgttccctcagaatcattctgtcctcactgaaaagcacacggtccaggataccaaaaagcagtgtattaagggccatgtagagagacagtgaaacaagggccgacgctactgccgccagggtaagctctgtccccagcctgctgattctcctgctcttactcaatccgatacccctttccccatacattgacaatatactttggattctttgggtccgcctccaacttcctgcggagattcctgatatgtaccatcaccgtgttattggcgctgtaaaaataggcttccccccacacgctctcataaatattctcaatggtaaacaattttccccggttggacgccagcagtaaaaggatacggtattccaaatccgtaagaagaatttcccggctgtttttcatgacctcattaaatgatttctgaatgaccagatccttaacagttatggattcctccccttcctcctccttacctttatacacatggtatcgccgtatcatggcctttaccctggccgccagctccgcataggaaaatggttttgccagatagtcgtcacctcctgccccaaatcccatggtcttgtcggagtcctgggtgcgggccgtgaggaacaaaatgggcgtatttaacttccttcgtatctctgcgcaggcagaaaatccattacgtcccggcatcattacatccagtataatcaggtcaaatgtatcgtctgccgcagacgcagcctgctccccgttctctgcttccacaacctggtatccctcactttccagcaggattctcactacctcccttatctccggatcgtcatctgcaaataaaatcttccgcttgtccaacctgacacctctctttataatggcgtgtttcattttttaaccatccgggtatggatgttccgggatggccaaactatctttcattatatctcagatattctctcacttccaccaaatagtcctattgattcaactgtttttgtcccttcctcctgccgttccctcctgtcagtcatgtttgattgcctccagcgctgaaatctttactgctttgccggccggataataacccgcccccacgcccactgcaatggaaaacaggaccgcaaacagggacagccaccacggtatcacggacagcctggaaggaatccccgccatgtccgcgtccatggctccggccatggatgaggacgacattccttcggaggtcatattcatgacaaaggatacggcataactgaatacagttcctgtcacgcctcctaacagcccgatgcagcctgcttccagaaggaatatccttcttatgtccctgacaaaacaccccagcgacttcataactcctatttccctggtccgctcagatatggacataatcatggtgttggtaattcccagggctgccacaaacagggaaatggctcccaggccgcctaacatcatctgtttctgtctggcctcccgctccataggctttcggatggtctccatggagctggtccgaaatcccatacgttttatttccgtctccacctccgccacctggttcatatcctttacctttaccatggctcctgaatatccctttttccactccggcttcctgccgctcagcttagcctgctggtccaataaggtcttaagcatttccaggtccatgaccacccccatggatgtctcctctccttttccgtaatcctccttcattcttcccgcggcttccagctggcgcgtgattttcttgtcatcctccttatcgctgctgatgtccagtgtataggaggttttcatggagtcaaaatacggctggggcttcacaggcattcccctttcatccaggttatcatatccgctgtacatatcaaccgtgtttctgccggaaggcctcttggtgtcctcaaacatataggcaaaattctcccccacaaagacaccatcccttccccccttgtcccaggtcccgtccgtcagcttgtatcccatggcttcggctgcctttacgtcaatgcccacaatggtggtgtaagcggacttgtaacgccggtttcttccggcatacagggtgatggggatgttttcagctgtaagttttggcgtgactgcctccactgatttcatttcctttaaacgccggattgcctgattattcagctttgccgagcggctccctttgccggccgaatatacattaatgatggtcaggtctcccatctgggccagcatgttcttctgtgcctccttcattccgattccaatggatatcataatgaccacggagcagcagcctatgatgactcccaatacagtgagaaaggtcctgcttttatggcgggtcagattctggagacatatggtgagtaagtcctttgttttcatgatttatcttcctcattttccgatggctgatcacggctgtcctccagttcatcccagccttccaagacctggctgtcctccagttcatcccagccttccaaatcctgactgtcctccagttcatcccagccttccaaatcctgaccgtcctccagttcatcccagccattctgctcctggcaccgcttgcggcccttcaatcctttggctttatttctcttaatccacagaattcctgccaccagtgctgcagttagaataccggccatcattttccagttcattttccttcccccatccatttctccgtccatcatatctgcgccgtccgtttcctcagcagctccttctttcacctcgaatgtcacaggaatctccatggtccttatctccatggactcgtcctcatatgtcacttttaccctgccctcaaaggtccctgcctttttcggggttgctataaaatcaatggtcccgctttttcccgcatcaaaattccccagattcaggcttctgtcaattacctgtatgtccccttccaaactggcttccacattgtacacctgtcctcttcccttgtttacatagggaagcgagatggtggtctcctcattctgacggatttcctccacaaaagagggcgggctcacctggaaccggtctggctggtaaaccggcactgcaatggtttctgcggcagtagactgttttctctctgttttatcaatgtactcatatttgcacgatatggttatcttaggggactgtaccttggaatcctttgtctggaacaatgcctggacatccacctgctgtgcttttttctcacccggtcccatctttggaacataaaatgtgttggaggacgagttgatagataaaccttctcctgtttccagcgaaatgaccacgttttctatgggggacacctgactggtattcataaactccatgttcagacgaaacacctgtcctgctgagactttatctccatatgtataattagtcagtatgatatttggcgtgggggctcccggagtggctgtcttgccattggtaggcaccacgattcgttgggaatacgtaccctggaccgttcccttatctgtatcgtaatcaaatttcaaggtgatacccaaaagctgggatgcagctgacgacagttcggagcccgccttaaggttcacgggcacgtccacggactgtcccggcccaatatccccaatctgccgtgtatcggttgcctccagaagagatatctggtcatttggctcaaaggtggctgtaagattccgtattcctttgactgtgtcggtattctccagttttaaagtaatctgaaacggctggccggaactcactggtcccataggtcccctgtctatgagcagcacgggctgtcctgtggccgtgcctccttttacaggcagaagcaccttttgcacagaggcagccgatgtaagctgtcctcctgaatagtagttgtattttaactccaaatcaataagctggctgggaccggatatatcctgtcccgctatcagattgaatttaaccagctcgtctctcccggtatccaggcggctaacgatccttgtgttggtgtcaccgcctatgaacagggaacttcccggcgatacatttaccaccatatcctcgatatccgcatctttactggtgttctcaagctccacttccagcgtgaagtggtcaccggggccaacgggattttgcggcgagattctcctgactcttatgattggctgccctgtggtgcttcccgtatccccattttccctgggcgccgactcctcgcattccgaaatattcacttccagctgttcagagggaattccggaactcttaaatcccaccttcagcctcagaacatccccctttcccgtataagtaagtctggtaaatgtcactgtaaactccaggtcgtcctccttgtccgatgtgatctttacctttggattttccccattgcggaagctgtcgctgagttttgttaccgttactccccgttttcccacctcacttgtcttgattccattgcttcttacattgaccaccacctttgcctggcgccctttgcgcagcacatccagggtgtcctttgaaccgcccggcgcaaaaatctcatactcacccacccacaggcttccacttcccggggcaccatcgtccggattattggaatcctcctttcctctgacccgtcccccgctgccctcctggctgccgccgtcctgagccccgctgacggaatcagcccctgaaccgcccgtctcacggcccatctcacggcccatctcacggcccgtctcacggcccggctgggatgtccccgctacaccagtttccgttccggcactttctgttgtgctgtctcctgctccgttggctcctgctgctccggcttccattcctccagtcccctctccagccattccgccttcgtttctctcattaatcccttctgcggcaatcgtttcccgccccccggaactgtctgtctcctctgccaaagcatttccgcacattcctattatcatagcggctgaaatcatcactgccgctgcccgtttgagccttcctgttatctccatcctcactgtcctttcctttcatctcccgttatgattccgtccaccagggtcacgattcggtctgcatacctggacatgcccgggtcatgggtcaccagtatgatggtctggttaaatcttctggcaaagcccatgaccatgtccatgatttccgctgttgtttttgtatccagatttccggttggttcatctgcatacactacctcaggtctggacacaaatgccctggctattcccgctctctgctgctggcccccggacatctgggagggataatgatgaagccggtgtgaaagccccacacgtttcagcatttcttctgccatggcctcccgcctcttccggtccattcccttaaacatcaggggcatagccacattttcaaccgctgtcatggacggcagcagattatatgactgaaagataaagctcatatgttcctgccggaaagcggccagttcctcctcattcatatccgatatatttttcccgcggataaacacctgtccttttgtgggtttctccattccggccagttgattcaaaagcgtgctctttcctgaccccgacgttccgaaaatacagcagacctcgcctttataaatcctcagattaatccttttaagggccaccacttcctcatcccccatccggtaaaccttgcgcacatttttaacatatatgattggttttccatggtccattatcttgtcactcctctttttatgtgtctatgatagaaaataatcccctggaaaatacctcatataaatcttaagaaatcttaatttcacacatgtctgtattttgggatgaccttttgctataatggttccatatgaacggataactgccggaaaaaggaggagaggaaatgaaaggcgcgattctcgaaaaaggtgaaacaggttacacctatctaaaaaaactgttcctttcaatccgccacgcccagaaggactttaactggctcatcaccgactgtcagtgctgtacccaaagcaaagccttttatcagagaatattccagtatgaccgatatggctggctctccggagaggagctgacccgcatggttgagacagaggatttccagtggatttgggctgttctctccggcttcccccggcatatctccctggaccaggtactggaatacgacctgccctatgctgacatgtacaccggattctggaccaatcctgtatccatccagcaccccctggcccaggtggaaatcgttccctgggacagttcctgcacccttgtcataagccggaatcacaggatcgtgtcggatttcatggatggttttccccttagcagggatttatctctgtacaatgagcaaaagggaatctttgatgagtcggatgaactggagcgctggctttcgcagcacagataaggccttgctccaaaatcctctgcccatcggaataaagcccaatacaaaaagaaactccatttcggaaggtggtctaattccggaatggagtccgttttcaggaaaggagcacaatattggaacatacattttggaccgcactggacaaattagtggaacagtcagagattatcatagaccgtccaaaggggtcggttcatcccggacatccggactttatctatcaggtggattatggatttctgagaaatacatcatccatggacagggagggcatagacatctgggcaggcagtgaccatacggccgggattgacgccatcctgtgtacggttgatttgttgaaacgggattctgaaatcaaaattctcctggattgtatggaggaagaaaagatgttgatatacaaagcccacaacgatacctcatgtatgaagggcatcttaatacgccgaaccgcagggatttcttataaaccatgagagaattatcaaaattaccaacttaagcagtcaggcccattgagccgcttttatgaatacctctgtcaaaaataagattcccataagtaattattaaatattttcatattttattaagaggctgctcaaacttttgacatatctgaactgtatactttagtcatagatagataaaacatcctaattaatacaatatacagctttttcatacccagccggcacgacccccattgtgccggctcctctccttttcagggatacataatcctatcctcccgtactcaccgtcttataccactgttcatcccaaaatccccctttcccttctttcctatatccctattcaaatgaacagccatgaataaggctgtcacggcggagagaacatctgctgccggctgcgcatacaggatgccgtttaatccccacaacgccgggaaaaccaggataatgggaacaaaacaaattccctgtctgcatgccccaagaacaaacccctcccctgcctttccaagagccaggaacagagaggaatatacggtgtagaatccaaatagcaggaaggataatccattagccttaagagccttttgtcctatacgaatcatttccatgtcgtcctttgtaaaccgtgaaataacagggtcggagaaaactgccatagtaagcccgaatgccgcgcagaacagggtggaccacaccacagatatcctgattgcctcatgaaggcgctcatagttccctgccccgtaattataaccggcaatgggctgaaatcctttgatgaatccaaataccatcaggcttcccagggaaatcattcttgtgacagctcccatcccggcaatcacagagtccccatacggctttgcctgcatattaatcatggtgatggagagactggtcagcagctggaaggccagagtgggaatccctattttcagtatctcagacataatttcattggaaaaacagcagttcctgaaacgaaagcagaacatgctccttccgctgataacataatacagatagaccagggtggaaactgcctgtgaaatagccgtggcaatggctgctccggccactcccagcttcaggacatagataaaaacaggatccaggaccatattaagcgcagcgcctgtcagcagaacgcacatggtggtcctggctgcgccctcgctggtcacaatattattcatggtgacgttaaacacattgaatatggatgacaccacataaatacccgcatatgtaacagcatagggaagtatactgtccgttgctcccagacactttaacaggggcttcaaaaaaatgaccgcgcaaaggatgaccgccgctcccacaaaaatactgctgtacagggccgtgcttgccgccctgtccgcagtctccctgtcaccgcggcctaacagtctggatatataggatgccccgccgtttccaaagagtaagcccaatcctaccacgacctgccccaggggaaacgcaacggaaatcgcccccatctgacttgtccccagacctcccacaaaataagcatccaccaggttatacagcgcattaatcatcattccaatcatggtgggcagccccatggctaacagcgcctttggtatgggcgcgtttcccagcagctccattttcttattacgtccttccatcttgtactctcctttcacttgacacaatttgtaaaatatagtactataaattatagtaaaatggccatagggcacatgatactataatttatagtacttgtcaagagaaaaaaggaggtcgccatggcaaccatagatttaattgtactgggtattttaaaaaaggaatccctgagcgcctatgatatccagaagctggtagaataccggaacatttcaaagtgggtgaaaatcagcaccccatccatctacaaaaaagtaatccagctggaagaaaagggatatattaagagcaatatgataaaagaagggaaaatgccggaaaaggcagtctattccctgacagaagccggtgaacaggcatttgaaggcctgatgttggaaattgcgtccaaaccaatccacatctttctggattttaactccgtcattgtaaatctgccaagcctgtccccggacaatcaggcagattgtctggacaggattgaacagaacgtgaacattttaaaaacatacctggaagaaaatatctcgctgaaagaatatttgccggagattcctgagacaggtatggcagtgctgcagcagcagttcatcctggcccaggcaattgaatcatggattgcctccctgagacatactttgccggaatcatccgtccatgcagtgccgcaaagcagggagagttaaggcaaacaccgctatccccagtgttgccccgccggatatcagaaaccagttctcgattcccagcggaccggccagggctcctgacagaacaagccccagcggcattgccgccatgctgatactgccggacaatgacagcgccctgcccaggtattccccctgaattttgatctgataaatggatgtctgtaccccaaaataaaaggggacagagattcccataaaaaatgacaggaaggcaaagatataaaatccttgtggaggcagcaggccggttatcagggtaccggctccatatatacctatggacccggcgattgcctttatcttgtctatccgtccgccccatatacccagggaaacagagccaaccagggtacccgctgcaaaaacagtctccaccagccccgattcactgacactgccgttaaaataagacatggtaatcagaggatacagggtccctatgggaaaatatatgactgcatataatgcgccaatcaccagcagctcccgcattccgggtacactgcgcataacgttgtacccctccttgacctctgccagaagattcgttttttccttatcttccctgaaaattcccggtatatccactgccgccagggtacccactgcaaaaaacgctcccaacacatccagcatcagaatggctttcagcggaaacatactgtacaatacagccgcaatggcaggactggctatcatggacgcagattcaaagctctgtgaataaccggcgtattttgtcagctggtcctttggtaagatggacggcataatagcctgaagggacggggcataaaacgcattgccaatgcttcggacgaataatacaataaaaatcagccagatcggaatgtccccccaaatacctgaaacagccagtgccacacaggctgaggacatcaccagatccgagcaaatcatgattttcttcctgtcatgctggtcaatcagcacgccgatgaacattcccagtacggcctggggcaggaacccggccagcgttgcaaaggaaagaacggccgctgactttgtctttccggttatataccatatgattgccatttgtacaatggagctggtcagggtcgatatgccctggccggtccaaattacaaaaaacttctttctccatcctgcaaactgctgttccatggttttttccgctgcctcctctgctgctctttcattgtcaacattacgctgtcacatattttctctccgccatatatcatccatcctccggaattcatatcccctcccgctcaaatatctccttcagcctgagggcgtcctccagcgtattcttccagccatcccgtttcatgtccacgcgtccctccgccgataccaggacctcttcctcctccaaaagcattctctgcaggtccggatgttcaaaggacgctgcgccggtcagatatccctggctgttgaccacacggtgggccggaacttctccggccagaccgcggttcagcgcataacccacctgccttgcgtttttcggttttccgcagagcagggcgatttgaccataggtagctacccttccttccggcactgtcctcaccgtaattcccacccgtttataaaaatccatcttccttatcctccggcagcagccatgcccatttatctcacttactttttcggaatccattcctatatatctaaatcctgctcacaatctatacaaaacatgcctgaatttccacgcataaactccggatactttttggaacaatttgggcatacaaacccatgttcattgtccaccatgcattcatcgcagagcggagcatcattacaggtaaaataacattcaacaccgctgaatcctattctctttccacactcatcgcagtatacggaattttccttaaaccacgcgctgtctttggctggtacatattcgttacagctaatcaaatcatacaaagtcaattcgttcagctctataggcaaatcaaacgcttctgtatctgccgaatacacattacagccatatttctcaataatatcctcttcgtccgattcatccattgtgtattctccatttaaaacaatctccatttgaataccatgccgttcaactacatctaaatacgaacgatagatatactctttttcttcatggtcataacaagaattttcttcgtcaagatatcttgcatttatttttatgtcgatgtcagctgagacatgtattttgacattttccttatcaacgatttcacaatataaaaactctgtttgtatatcatctatttcaatggtgtcaagaagctcgaattcaggctcatcataattgcagaattcacaatcctgaatatattcgcatatgattctggttatatcgccatttctttcgtcttggcaatatttttcaaaagcatagcacacttctttcctgcgagataggaactgtaaaaactttttatggtattggtatactataaatgatttgtcatttaaaaaagaggttctgaatccttcatcatcagataatatatgtatttcctctccaatatatttctgatagttttttagagcttttatcattatagcatctttaaactcttttggtttcttaggctcaaatggagggttcatatgataatagtcttccatgagttcctcaataccaataccctcaataggaaatacttccgcctctaccctgctcagataattttcaaatccagatgtaagtgattggatggcctgtacttcatctaccctaatataactatccttatatcttgtatcagatttaagtgcaaaaaaaatacctttcttgatttttttatttacttctcttataatctcttcaacatcagctttaatatgcattttaacttcatttgagcatatgctgcatgtaagaagctttacttcaccatccaaagaatatttctcaaccgctgaaaaaaaatcattattaaacacataccctgaacctatgtatatatttgcgtcaacaaaaagataaaccatcccatcaactcctgtttctattttctaaaaataattgattaatcatgggcaaaaacgctttttcttcattcgcagaatacgatcccacaaaacaaacttaaaaagcctgccatcggacttctcattataaaaacatatcaacattgtaccatggtacgtgtcattttaacagacaaaatacaaaaccaaaaaaagcccctagggcaaatccaaaaacacaggactgccctgaaggccttcttactatttcatatacttctgatgcatttatttcccctgtccataataagcattgggcccatgcttgcgcatgaaatgcttatcctgcatacactggggagctggtcctgcctggggattgatgagttccgtcatgaaattcatcctggcaatctcctccagcacaacggcattgtgcactgcctcagccgcgtccttcccccatgtaaaggggccatggtttttacaaagcacagccggaatgtaaaccgggttcttgccctggaaggtctcaatgatgacccttccagtattcatctcgtagccttcctcgatttcctctgccgtcagatttctggcgcagggaatctcaccgtaaaaatagtccgcatgggtggtgccgtaacagggaagggccctgcctgcctgtgcccaggccgttgcatgaggggaatgggtatggacaataccgccaatctccttaaacgcattgtacagctccacatgggtggctgtgtcggaggacgggttcatctcaccctccaccttattgccttccaggtccatgaccaccatatcagatggctttaacacgtcgtaatccaccccgctgggctttatgacaaacaatcccttttcccggtcaattccgctgacatttccccaggtgtaggtgataaggcccctgcggggcagctccatattggcttcatataccttttgtttcaattcttctaacataatctgtatccgctcccgttcctgttaatccttctgtgctccacagcttagtccttcttgttcacagctgagttcttcttgctcacagcttaatccttcatatgctccacagcagccttctcaatggcaagcccctctgcataccgcttcatgaatgcctcgaatccttccacatcctctttcacaggctccattctggttcccttatccccggcaaaaaccttgttggccaggtaagcgtccagggtctcgccctcctgcctgcaccgcatgtaggaggccagcagcgcaatgccccaggcacctccttcaccggctgtctccatgacagacaccggcgcgttcatggctcctgccaggattctctgtcccacgccctttgtcttaaaaagaccgccgtggcccagaatactgtccaccttcacatgctccttcttaagcaggatatccatgccggtcttaagggcgcccagggatgtatacaggtgtactctcatgaaatttgccaggttaaaccggctgtccggcatgcgcacaaacaggggacggccttcctcaaagtgggtgatgtgctctcctgaaaaataattgtaggccagcagtccgccgcagtcggaatctccctccagggccttgttgtaaagggttccaaagagctggttcatatctgccttcatacccatggcctctgagaactccttaaacaggttcacccatgcattcaaatccgacgtgcagttgttgcagtgcaccatggctaccatatcaccggccggcgtggtcaccagatcaatctcaggatatacgtgctccagttccttttccaataccaccatggcaaacacgctggtaccggcagacacgtttccggtgcgcacagccacgctgttggtggccgccatgccggtgcctgcgtcgccctccggcggacacatgggaataccggctttcaggtttccggatgcatcaagaagctttgccccttcttctgtcaggacacctgcgtcctctcccgccaccagagccttgggcaggatatcacgcagcttccatgggaaattctctcctgccaccagttggtcaaactgctccacgcgcttctggtcaaaatccctggcatggatgtccaccgggaacatgcctgccacatcaccaatgcccagaacacgtctgcctgtcagcttccagtgcacatatccctccagcgtaatgaggtagtcgatatccttcacatgctcttctttattgaggatggcctggtaaagatgggcaatgctccatctctgaggaatattgtaccggaatacctctgtcagcttcccggcggcaggacctgtaatggtgttcctccaggtgcggaagggcaccagaagctcgccctctttatcaaatgccatataaccgtgcatcatggctgaaaaaccaatggaaccaatggtggtcagggtgatgccgtaggtttccttcacatcctcagccattttgccgtagcagtcccggatgccggtccagatatcctccagggtataggtccagatgtgatccacatacctgttttcccaatcatgactgccggaggcaatgggtgtgtggtcctcaccgataaggaccgccttaatcctggtggagcccagctctatgcccagggaagtatttccatgctcaatctgttcttttatcttatttatatctaaactcatgaatcgcccctccacttgctcattaaggagcgggcctgagaacacagtaaaaatatgctcccagggtccgccccatatatcctgtttctaatccgcaggccgcctcaaacctccgcagcttccggacgcaaatcattctgcctgatgcctacctgtaagctgccgcattccagcgaagctcgttcttaagagcgcggatgcttgtgtccttgtcaatatagactgtctcaatacccatggcatcagcccagtctcccatctgctcggccgtcaggtcataggagaacgccgtatggtgggcgccgcctgccagaatccagctttccgccccggttgccaggtttggctccggcgtccagaacgcggttgccacaggaagcttaggcattggcttttctgtttttttgcactccacatcgttgataatcaggcggaaccttgtgcccagatccactaaggatgtggcgataccgtggcctgtcttggatgtgaatacaagtctggccgggtcctccctgtcacccatggacagcgggcaggccttgatgctgatttccccgtctgcaatggtggggcatacctccagcatgtgggcttccaggattccctccttgccgggcactaggttgtatgtataatcttccatgaaagaggttcccttggcgtccttcatgccctgggtcataatcttcatcagcctgaccatggcagccgtcttccagtcgccctctgcgccgaatccgtatcccttttccatgagacgctggatagccagtccgggaagctgctgcagctcgcccaaatccccaaagtgggtgacgatggcgtggtaatccttctctaaaaggaacttctcaaggccggcctcaatctgggcctgtaccgccacatggcgcttaaattcctccggatccctgccttccggcaggatggtgtacttgctgtaatactcgtccaccagggctgtgatatctccctttggcacagcctttacatactcggccagctcattgaccgggtaagcgtccacttcccagccaaacttcatctgggcctccaccttgtcgccttcggtgacagccacattcctcatgttgtccgcaaaccttgccaccctgacatggctgctctccatgatgcccacagcagtgcgcatccatgcggctatgcggcccaccaccttctcatcgctccagtggcccacaatgacctttctctctatgcccatgcgtgtcaccatgtggccgtattccctgtctccgtgagcggactggttctcattcatgaaatccatatcaatggtgtcgtagggaatctcctggttaaactgtgtatgaaaatgcatcaggggctttctgtattcctgcaatcccaaaatccaggacttggccggtgaaaatgtatgcatccaggtgatgacgcctgcacattcctcatccgcatttgcctcgttaaacgtcctgcggatcagctcattggtaatcagtgtgggtttccacaccacctcatagggcaggatgcctgatttattaagactgtccacaatgattcccgaatgctccgccacatgtgccaggcactcatctccatagagatcctgtgaacctgtacagaaccagaacttataattctttactgctatcatatctctcatcctccttaattgtcagcccctcaggccgctgccggccggttggcgcatcgctgtctgtcaatcttctgtctgttcttcttcctcatcatccggaatctcgccatacttaatatattcgccttttatgaatttcttaagggaccagccggccagaaatgcacctatggcgccaaaaagaactgcacagccaagctgtaccatcttgcctccgcccgcaggttttaaaaactcctgcagcaggccgaaggccaggtatacaagatagccacctgccgccagacgcagtattacggttatctgagttggtttcgcggcattttcttctttctttgcaccggtttttgcacccattacatttcctccttatgcggctgtttcaggacctttaccgaatcccgctcaatgatatccgaatcaaacagataattaccgtcaaaatagggattttcaatcatacttatcatgttctctgctgctttcctgcccagcgcctccatggggtgcgggaaggaggtaagctttacaccggccagggttgccaggtccgagttgtcaatgctgacaacagacagctggtccgggatggcaatgccccgcttctcgcagagtcctgacagcacataggccacctcatcgttgtagcataccactcccgtacagctttccagtctgcgaaacagataatccgcccactggtccagatccagaaaatcttccgtgtccagccataccacattggcatcctttaccttgattcctgcccccagcatgcctgacaggaaccccttatacctcaaatgcccctgtccgtcatcgcttttgaacacgcctccgatattccggtggccgttcttaatcagatactccacagccttcttgcccacctgctcgtcgttcatggacacgcagggcagctccagatccggataccggctgttgaagaacaggatcgggattccccgttccttaagctcctggtagtaatgcagatttggattggggagggcgcttttggccggctccacaatcagtccatctataatgtctttgtcgatcaggttattcaatatgtcctgttccctgctgacccggttgccggtaaaggcaatctgggtggtgtaacctttttttgagagaaccctctcgattccccgcaccacaggagggaaaatatagctgtccacataagtactgattacagcgatgttcatgtaccgctcctggcgctccgccttgccgttgccgcccacatacgtaccgcttccccgcacccgtaagaccagcttctgctgctccaggatatccacggcatggcgcaccgtctggcggctcagcccgaaacgctcgctgagttcattctccgaaggcagcttttcgcccaccttcaaagccccgctgttaatgttttccaacacccagttatagactgctttatatttcagctcctgtgtacccataatcaaaacctatccttttttcctctttgataacaagtctaccgtaaccgcacctaaaagtacagcgccttttactattttctggatgtcggtggaccatccgtagagggacataccattgttcaggatacccatgataaaagcacctactacagctcctatgatggttccgataccgccgctggtagccgcgccgccaatgtaacaggaggcaatggcatccatctcaaaaccgtcgccggccttgggggttgcggaggcgttacgtgcggaaagcacgatacctgcaatggcacttaaaatacccatgttggtgtatacccagaagaacactttctcagtattgataccggaaagctttgccgccttggcattgccgcccagggcgtatatctggcgtccggcaacggtcttgctggtgatgaaatgatacaggcccaccagtacgcccatgatgaccagcacaaacgggatgccgttatagcgtgacagcttgtagaagaagaaccatacgatcatcagtatgacggcttcctttataataacctgccacatggggttggttgagaaaccatattttttctttgtattgatactcttaagctctgccataatcaccagtaccgtggcaatgcctgccacaataatggaaaccaggtccagggtgccgtttccaaagggaatcttcacagtcggcagaaagcctgcgccgatgtaagtataactggtgggaaggggtccctttgtctgggcctttaacagggtatatgtaagtccgcggcccataagcatggttgccagggttacgatgaacggcgggatgctgagcttggatacaaacagacccacgaacataccggccagggcgcccactgccagggcagccaggatggcgacccacatattggtgtggtagtcaatcatcaggatacctacggttgcgccgcacagggccacgatagagccgacgcccaggtcaatgtttcctgtcagacagcataacagcataccaactgccaggataaccacatatccgttctgcatgatcaggttgttgatgttggccggcgacatattctttccgccggtcatgactgcgaaaatcaagaacaccgcgattaaagcaagtaccatgccatactgcttcatatcaatattaactgttttcttcttatccatctctacgcttcctttccattatccgccataatacatttcatgattcgttcctgggttacctcttccttggtcagctctcctgcaatccgtccttcgttgatgacgtatacacggtcacaggtaccgattacctcctgcatctcagaggagatgacgattaccgccttgcctgacttggccagttcattgatgacgcagtaaatctcatacttggcgcctacgtcaatacccctggtaggctcatccagaatcagcacatccggctgtgtcagcatccacttggcaagaaccaccttctgctggttgccgcccgatagggagcccacggtctggttaatggaattagacttgatgttaattttcttcttgtaatcctccgcagccagaatctcatcattttcattgagaacgccgttcttggaaaagaaattcctcatggcggacagggtcatattccacttgatatccttaatcagcacaagtccataattcttcctgtcctcggacacgtatgccagtttgttgttgatggcgtccttaacgtcctttatatgtacttccctgccgtttatcttaatggtaccgcttattttctgtccgtaggacctgccgaatatgctcatggccagctcggtcctgcccgcgcccataagtcctgccaggcccacaacctcgcctttgcgcacatgaagggaaacgtccttgatgacctgcctctgggcgtcgtcgggatggtacacattccagtcctttatctcgaaaatcgtatcaccaatttcacagtgccgttccgggtaacggttggtcagctcgcggcccaccatgcctttgatgatgcggtcttccgtaaattcatctctacccttctccagggtctcaatggtctttccatcacggataacggtaatggaatcagccacataactgatttcgttcaacttatgggagataataatgctggtgattccatgggatttaaggtccagcatgatgtccagaagccggcggctctcttcgtcgttgagtgcggctgtgggctcatccagaatcagcagctccaccttcttggccatggccttggcaatctctatcagctgctgttttcccacgcccaggctgctgatgggcgcgttcaggttttcgcctcccagtccaaccttttcaagcatttcctgggccttcttatgggtaagtgtccagtcaatgatacctttggctgctttctgctcatttcccagaaacacgttctcagccaccgacatgtacgggctcagggccagctcctggtggatgataacaatgcccttggcctcagactgcttgatgctgtggaactgacacacattgccgttatacacgatatccccgctgtatgaaccaaagggataaacgccggacagcacattcatcagggtggactttccagccccgttctcaccgcacagcgcatggatttctccgcgtttcaccttgatattgacatcgtccaaggctttcacgcccgagaattccttcgtgatgtggttcatctccaaaatataatcggacatcttttcaactccttttcttgaaagatactctgtaaaaagcgcaatcgggcggcggaacctatgccgccgcccgaatcatctttactgtgccagctgctcctctgtatagtagccgccgtctacgataatttccttatagttgtccttgtctactgctaccggtgtgcacaggtaagcaggaaccacaaccttgccgttattgtactgttcggtgtcgttgatttccggctctgcgccttccagaacagcctgtaccatggttacgcacttctcagccaggagacgtgtatccttgtaaatggttgctgtctggtaaccggagatgatgttcttaactgccatcagctcagcatcctgtcctgtaatcagcggccagtcctcgccaaccttgtagccggcgccttccagagcagccttacagccgtatgcaaaaccgtcaaatgcgcttgcgcagatgtctaacttctcgtcagcatagaaaccggtcagatagttctcgcagttctgctgtgctgtttcctgggaccatctcaggatacatgtatcctcaaaggaggtacgtccggacttgcagaccagtgttccgtcatccaggtatggctgaagaacttccatcagtccgttgtacaggaacagtgcgttgttgtcatcaggtgagcccatgaagaactcgatggtgtaggactcgccggctgccttggctgcgtccaggtcctttgcttcctttatgtagttgccgattgcagtaccaactcccttgttgtcaaaggttgcatagtaggaaactgcgtcggtatccatcagaagacggtcataagcgatgatggggatgcctgcgttcttagcctgctcctctacgtttacaagtgcggaggagtcgatggatgcgattaccagacagttaacaccggatgcaatcatgttctcaatctgtgaaacctgcatctgcacatcatcctctgcatactgaaggtctacttcatatccaagtgcttccagctgcttcttcatgttggcaccgtcgttaatccagcgctcggatgactgtgtaggcatggccacgcctaccttcttgccttccccggttgctgccttggctgcctcggtagctgcgtctgccgctgcggtggaatcagccgctgctgcggttgtgtctgctgccgctgccgctgtggtagctgctgcctcctgtgagccgccgcatcctgttaacagtgaagctgcgattgccgtccccagtatcatgcttaaaatttttcgtttcatatgttacctcccatggtttaatttatacatataacttgtgtacatgttcacaagcttgtactttcgttaattcagctaacccttgtgtcataccatctgattcatttggactattttgcacttttgtagattttactctgtatgtattgtgcgtttcgtcaatatttcttacgtttttctttaaatacactatacatttttgatgcaggtttgtcaataggtatttagaacttttttatattttttattgttgtacgtacaactttaacgtcattttttctattttcgtctaaaaacgacccgtttcatcctgtaaatagttctgaatcccattccccggacgcaaaaaatgccagcaagccgacgacgggcttgctggcacaatgttctgttaaatttttaactcttttttgttcacttttgcctgacggcggtgtttcggtgattcccgctacttgttctttctcttcagggctgcaatcagactctgaagcacgatgaagaagcacagaagggccgcaatggtaattctcacccaccaggaggaaagcgttccctggaaggtaatgaaggactcgatggttcctttaatcaaaactccgaaaaggcttccgatcacatttcccacgccgccggtcagaagggttccgccgataaccgaggacgcaatggcatccatctcaaatccctttgcctgctccacgaaaccggagcatgtgttcatgcagaacagaaggccgcccagtccagccaggaatccatccagcacataagcctggagcttgattcttctcacattcagacccagcagcagggcagactgctcatttccgccaatggcgtaaatagaacggccgaacttggtatacttaagcactacaaacacaatggccagaaccaccagggcaatgataacactggggtatacgtaaggataaatcatgactccctttttattcaggtaaccgccaaagggcaggtacatcttgaatgtggcaatgccggtaaatgtcttatttgtgatactgatcatctcctggctgataatggaggtcatgcctcttgcaaagaacatgcccgccagggtcacgataaagggctgtatcttaaggtaggccaccaaaaagccctgtaccaggccgaatatgcatcccgttgccaggacgataaggatggccggaaacgcaccgatatttcccctctccatcatccaggccagcatcatacacaccatggccaccacagaaccaacggaaatgtcgataccgcctgtaatcatgacaatggtcatgccggttgccaccacaatcaggcccgcgttggatatgaacaggttgaggaagttctgtacctttgcaaatcctctgccgccaaacatgatgatgcctactatgtacatcacaaagaataatatgatggtcacagccaacaggaaggagttgccgtccagtcttttcttttcacttctgtttttcattatgccactcctccttccacattcttggatgaatgtctggatgccagacgtttcctgaatttcttaagctcctctgactgcacagccacaatcagtataaccacaatggccttatatacaggaatctggtccgcaggcacgctcatggcatagagggtggtggtcagggcctggatggtatatgcgccgattacggagcccagcagggagaaccgtccgccgcccagggagttgccgcccagggccactgccgcgatggcgtcaagctccatgttgaggccgatgttgttggcgtctgcggaatagatacgggaggatgccaccagtcctgcgatacctgcacacagtccgcagaacgcataggccatccagatgattttcacggatttaagacctaccagccgggatgccctctcattgatgcccacggactggatgtacattcccatggctgttttcttcagcagaatataggtgagcaccaccacgattacagctacaaaaataggggtgggaatgggaattcccggtatgttgttgcccagcagcttatatccgtccacgcggatgtatgtgatctgtccgtttgtcaccagctgggaaatacccctgcccgcggtaaacagaatcaaggtcgcaaccatgggctgtatcttaagctttgcaaccagaaatccgttaaagccgccgcacaccacggccgctgccagggctgccagcacagccagaacgtagggattggcatactcattgaccgacacctcaccgcctgccaggaccctggtacacacagccgcagccactgccatgacagcgcccacggaaatatcggttccggcggaggcagataccaccagggtcatacccacggccagcaccaccagctcgctggcacggttgattacgtcaatgatatatccgtagaggacgccgttattaatcgtaatcctaaaaaacgtgggcgtggtaatcagattgattaacagtactatgataagacaggataacggaagaaacagcctgtaacctgtcaactttttaagtttccccatcattcttcccctcctcctgcaattgctttcatgatggaatcctggctcagctcgtcttccttaagctctcccaccttcccgccgtcgcgcatgaccgccatacggctgcaggtgcgaagcatctcctcgatttcagaggatataaacaccacggacatgccttcctccgcaagcttcagcaccagcttctggatctctgtcttggtaccgatatcaattcctcttgtaggctcatccagaatcagaaaatcaggattggtcaggagccagcgtcccagaattaccttctgctggttgccgccggagagctgtttgataggagtctccctgtcggctgtcttgatttgaagaatatcaatgtatttatccgtgaattcctcctgttccttcctgctcatgagcctgaacatgcctttcttggcctggagggcaatgatgatattctcgcgcacagacagatccgcgatgattccctcctccttgcggttctcaggcagataggccatgccttccatcatggcgtcaatgggagcgttgacctttaacttcttcccctttacggccagctcgccgctgtccggcttatcagcgccgtatatggcgcggaccagctcggaacggccggatcccagaagtcctgtaaggccgatgacctcgcctttatgtatatccaggctgaagggtttgatggttcccttgtggcccagccccctggcgcttatgattacatcttccttgaccgtggacacgccctccttcttgatggctgccagatcgtcgaaatccttccccatcatcttggccaccagctgtaccctcggcagctcctccaccttgaattctcccaccagggttccgtttctaagaaccgtaatcctgtcgcagacagcatatacctgttccaggaaatgggtgacaaagatgattccgattcccttgtccttaagctgtctcatcagcacaaacagcttttccacctcaccgtcgtccagggaggatgtgggttcatccagaatcagcaccttggccgacatatccactgccctggcaatggcaatcatctgctggatggcaatggaatagttctccacagccatggtcacatcaatgtggacatccagtccctccaacagcttcctggcatcctccttcatggtcctccagtcaatcatgggacccttttttggttctctgccaatataaaggttctctgccactgacagattgggacacaggttcacctcctggtaaactgtgctgatgccattttcctgtgcttcctggggcgaccggttgatgatggtattggatgaaccttccattcggattgtaccggtctcaaactcctccacgccggtcagcaccttgatcagtgtagacttcccggcaccattctcgcccataagggcatggatttcgccttttctcaaagtaaaatccacatcctgcagcgcctttacaccggggaaattcttgttgattccccgcatttccaaaacaacgttctgctccatgcgatttccgcctttctaccgttatacgccccatttccagggctcagttactagaacacacccagcctcaggcttgaaaagggggagagccgtgcaacgactctccccaccgcctttcctgaactgttacgaaaatgttgattaataagcacgctcagccttgatagactccaaatccatggatgtatcgaagtaagcttcgtctacatactgaatcttctcaacggtctcgcccttctccagcttcttgatgatctcatcaacacgcggtccgtgtaatgggttgcactcaaatgctgcgtttaaatcgccggctatcatggcgtcaaatgctgccttaactgcgtcgaaggagaagatgatgatgtcgccgtcaggtccgcaggtcttgccggctgccttgattgcgtcgatagcgccgaatgccatgttgtcgttctcagctactaccacatcaatatcgtcataggacttaaggaaggattccataacttcctggcccttagcctgtgtgaattcacctgtctgcatatctaacattttccagttgtcatgctgctttaagatgtttccgaaaccttctgtacggccaacctgagcggatgctccgatggttccctgaagagtaacgatgttgatgtcctcgccgtctcttccctgtgcctttaagtaatcagccagccagtttcctgctgtctcgccttccttgatgaagttgccgcctacccagcactcatacaggctttcatccacgtccatctgacggtcggacaggataaccggaatgcctgcttcctgtgcttcctggagaactgcttcccaacctgtctcaacaacgggagccactacgatgtagtcaacatcctgctggataaagcttctgatggccttaatctggttctcctgtttctgctgtgcgtcgtcaaaaatcagcttgtagccgttttcctctgtaaaggtggacttgaaggactctgtattagctgttctccagtcagactcagcgccaacctgggcataaccaaccacaatcaaatcaccggatgcagcgtcatcctttgcctctgcctctgtctcagcctctgacttctcaggagccgccgtggtgtcggctgctgccgccgttgtctcagctgctgcgggagctgctgttgtctctgcaggcttatttccgccgccgcaccctgccagcagggatgctgccattgctgcacataacataacgcttaatccttttttcctcataatacgtaaacctccttgatttgtattttgtttccccttgttggtataatcatatcagttgttaataacaaaaacaacggaatttctccgttgttttgtacacgatttttagaattttcacagtttgttcatacatttgggtgtttttttacgattatggttggatatttttcaatcctccccttccctgtcatatccggactccagtggtatattcaccacagcccttgtgcccagtcccaggacactcttaaattcaaggctgcacctggaaccgtagttcaggcgcaggcgctccgccacattaaaaagcccgaaaccgcccttgggcgcgggaccttcccggaaagccgggtctttttcccctctcagcttccgcctgacggcctccatctcctcttccgtcatgccggctccgtcatcctccacctccagcacagccatgtcctcctttgcgtatccccggacccatatgcgtcccctgccccttttattcttgattccgtggtaaagggcgttctccaccaggggctggagggtaagcttcaggattcttcgttcctccagggatttttcaagggtgacctcataatccatgatatcctggtatcgtatcttttggatctggagatagcttttgatatggccgatttcctcccgcatggtgataaaatcctttccgccgctgagggttgtgcggaaaaattcggacagggaggtaaccatgtccaccacagcccggttctgtcccccctctgccagccacacaatggtatccagggtgttgtagaggaaatgaggattaatctgctcctggagcagctgcagctccatgacgcggcgctggttctgctcctgccgtatatcctcaatcagccgtccgatttcctccttcatgtggtcaaagcttcccgtaagaattgccagctcatcccctgcctcaatcttggggccggaggtaaagtccccctttgcaaccctctccgtctcattacagagcttctgtatgggcacggtgacgctcttggttatcctgcggctgagcagaaggctgataatcaggatggataccagcaaagtcaggctgaccacaatggctgtgtgctcctggctctccagctccttctgtatctcctggacatggagcgtctcatagtatacatactccctgccctgcttttcaatatccgcagtcaggacacggacgccgtaatccagtatttccatgtttttatcatacatgccgtggggcaggttgtcctctatctcgtccaccctctgctccagctggtccaggcagtggagcagccagttaatcctggtccggttggccccctccggcgtccgctttaacagctggcggtaggtctttctggcatcgcttatggtctgatgcgggtccttaatctgttcccatccgtagggccggtcctcctccatcagctcatggatggactggtaggtccgcattcctatgacaatgcggtacatgctgtagtccacatcctcccgcaggttggccgtgacactgttggcctgggtgatgttggtgatgctctgggtgtaggcattgcagaacttggccacggtggccatgagatagataaccagcaccgccaggggaatgatgatgataaacgtcatcaggttcagacgcttttccaggggcaggcgatccaggatatggttcgtgtcccaatccttcccaatgccctgatccttctcatttgctccgccctgcccttttttgccggacccggtcctccattttcccgtcatgacccctccctgcttcccgccctgtactccttaggtgtacatccaacggttttcttaaacagatagccgaagtaatgggaatccttatatcccacctcgtacccgatttcagaggtcttaagattagagcacatcagcagctcctttgccttttccatgcgcactcctgtcagaaactccacaaaggtcactcccatctcctggctgaagatggagctgaaatagctggggctgatattgaccctggcagccaccgtgttcagggaaatctcctccttggcgtaattatcatagataaacgccttggcctcatccagaacctgactgtacttgctggctgtctggctgtccctcagggtcatgacctcctcaaaaagcctcaccagcttctccttaagcatgtccagggtacaaccgtccttaagtaccttttccatatccgacagttcccgggggagacgtcccatgtcaagtcccagctgttccagaaaggtgctgacacagagatagcagtccatgacaatgtactggcggaacataaaagactggcagttcttttcccccacattctggaaatactcctccacaaacccggaggcctctcccacggtcccctgtttcagaaaattttccagggtctttctgttcaccttggacgcatccactgaattaatatcaatggtttcccctgttccgtggaccatgccgtccatctggctgtagcttataatccggttcatctccgtgaagaatctggcggcaaacgccctccccgcctgcagataggaggtctgcaaatcgcccagacggttcacgcagcttccgattccgccgaaatactgtatgtccttacaggccccggccatctttcccaggctggcggcacactcgctcatcctgcgctccacctcctgctcagactcccccgtgagaacgaaggcccacccctcgtccccgcggtcaaaaaccaggatgtgctgccggccctccatccgttcctcaatcgcctcctggcaggataccacccggtcggaataggcaacggcagatcccataggcatgagcttaaacagcatgagctggtaaaaggaagcggacaaatccatccccacctgttctcccctctccagagcttccttaaaattcacccggcccgtcaccaggtcccgcagaaggcgctggcgttccagtactgtgttctcagccatctccaggcggtacttatccataagcctggcgtcctcccgctccttctcaatcacatccgccaccttcttcaccgcctccagaagcttggcagccgtgatgggcttcagaagatagtccgtcactccgatgtggatggcctgcttggcatagtcaaattcattatacccgctgaggataatgattttgattctgggaaattccttcttcaccagttcagagagttccagtccgtccatgaagggcatgcggatatctgttatgaggatgtccggctgcaccttcctgataagcggatatgccagttctccgtcgctggcttcccctgcgaattccagcccttccttctcccatggaatgttgttcttgatgccatttcgcatgacaatttcatcctccacaagaaatacctttatcataatccagttcccccctcttatgtatttttttccataccatccatttgctgtcttacagtataaaatataacacattcattttcaagattcttcctaaaaaagaaaaagcagagacctgtgtgctgtctccgcctttgtttcgttttaccggcttactgtttttcccggttcttccggttaatccattccgttgacacatccatggccgcccggcaggcccttgtctggtccagggaattcagcataacaaaatcatggattatggcctggaaccgcagggccgtcacatccacccctgcttcgcgcagcttaccggcataggcctccccctcatccctgagcacatctgcctcgccgttcagtatcatggcatccggcagacccctcagctgctccgaagacgccctgaggggcgaaaccgtaatctgagccctgtctttctggcagggagcatactggttccagaaccactgcatgcctgcccggtacaggtagtatcccgctgcgaattcattgtaggagcaggtatcaaaacaggcattggtgaccggataatacagcagctgtttctggatgaagggccccttcctgtactttgacataagggtcatggctgcggccatattgcctcctgcgctgtcccccgccacggtgaaggttccgggattcatggcatatcccatggatttcacaaggtcgggagccgtacacatgacgctgtagcactgctcaatggcggtggggcagcgcacctctggcgaacgggagtactcagggaatatcaaaaggcagccagtcctggcagccagctccctcaccagcttttcatgggtgtggaagcttccgaacacccagcctgcgccgtggatataaaagatcacattggcaggctggcaggaaacccccggatccaccagccaaaccggaatggtcccccatcttcctgtattgacccgcaccttgccgacccgggcgggatatttgtacacaggcgtatcctgggccttttccagaaccatccttccctcggcagggggcagctcaaatataaggggcggtttggaatttgcctgacagacctcctctgccgctggctctaacggtacacaacgtttcatatggaactccttcttgacaaaagtctctactgtcagaatattccagattccacattctgctcacctgttttattgatttgcactattttcttccgccttcttatagcatgtaatatcatggcagcacagcaggcaggcatcctttccgccccagtgtatccgggaggcgtcggccgatgaccagaccttaaggacaggattataaacctccatggtgtagttaatcttatcctccacctgcttcatgggacaccgttggcagggcttatcatttttgaaaaacgcttcatggcagctcatgcccagccttgaatccggcgcaagcctgtaggtcttatcgttaataaacagcagttcatgactttccatgtccaccacataaatccatgagttctggtggtccagaatagtccttaagtcctcggccaaatccacggcgctgtcctgtgccctctgcttaaggaggaacagggacagcagctcggacacaaaggagagaacctctatctggcttatggtccacaggcagtgggaggtacagtcatcaaatcccacccatcccttgaacacgccgttatccctgatggcacactggagcatggacttgacacccctttgcttcagccgtttttggatgtctccgggaagctggcctatatcatcgcagtaaagaatcccgctctcattaaagcagctctggtaatctgtactgaactccgcataggaacatccctgcagcatatccttctgggaccggattccccgggcgcaccactcaaaggtgttgctgtagcaggtcccatcctcggaattctcaaatacataggcgcggctcacctgcagacgctcccccaaaagctccagcacgctttcaacggccttgtccatctgctctgacttggacaggatgttaaaggctcttggaagcaggtcatttaacaccatgtccccattctgttccgactcaatggtggtattcacagttgccttgcgccccgctccctggccgaacgccttgtcctccatggactggtcgtagatctggtactgcttttttccgcaggccttggcctggtacagcgccacgtcagcccgccggaacaaagtctggaagttctccccatcccttgggcatacggcaattccgatgctgcatgtaatacagcattccttgggcagctcctccagcacacgctcaaagcactcgatgagccggccggccacagactttacccgctgttcattgaccactccctgcaaaagggccataaactcgtcccctccaatcctggagacaatgtcgctgctgcgaaacagccgggaaagctgtcctgcaatctttgtgagcaccgcatccccaaacatatgcccgtactggtcattgaccatcttaaaattgtcaatatcaatgacgaacagcgcagccccttccccttcctcccggttcaccagcaggtgttcgattctctgtctggcagattccttgttgtacagcctggtcagggtatcacgctccgcccgtgcctttaactcctgggcggcaagcttttcatcatttatgtcaataacgattcccactgccttgcagggctgtccctggtcgtcaaactgggtggtggccctcagcttgcaccactgatagcggcccttggaatcagacaccctgaactccagctcgccataccgccttccgtcccgtatctcttcgataagatgtccgaacggcgccatatcctccggatacagatgggatatcttaggtatccgtaccgatgcctgctccgagatggggtcatatccgaacttggccttccagttggtggagtataccactgtgtcagaaccgatgtcccattcaaagaaaatatcattggtctgttccataacgattttataccgttccagtcccaggcgcagctcctcctgggcatgtttggtctggtcaatgtctatgattacgctgtaaaagtattccctgccctcgttatcatacatcagacgccccttgtccagcatccagatactgcggccgctgcggtcctccacccggtattccacttcatattccccgccccggttgatctgttccgtcagctccctgcgcatccgctccctgtcatccgggcgtatcatttcaatgtagcagtcgttgaaccgttgttttatctcctgcctggtatatccgaggaacccctcgtcaacgtctatcatggtgaaccacctgtcattgcggcagcgcaggattcccttcaatatgttatgaagaacccggcggtcctcacggagcctgttttcgtctgaatccgcctccggctgcaagggttccatatgccgccacagcagcaatgccttgcggcggcggggatgttcgatgtccacccgcagaagggtcagctcataccactcctcagacctgtgctcatccttcagccggtacttccagctctgtttcagcattccctcttcaaagaaacgcggtatctctgttttccatatccgccgcacattgtcctgttcctccggcaccaccaaatcatttatgtagcattccgccacagcttccaggcattctccctggaacagcttcttaatccgctcgtccggcgcgtataccacatgatagctgcccgtggaaaagtccacctcagccaccgtggtatccacataccgcagcatggcaaaatacttcatctgttccagctgcagggcgctcaggctgccgtcccccacccccaggacactgccgtggtgggaaagctttgcaggcgcggggacattgccgtcccggtaccgtttgcacaggtcagccagctgcggctccacattcttaaagcagtccagcagcctggaggaaaagcatccgcattcaccgttcagaatcatgttgaaggcctgttcatggggaattgccttcttataaacacggtccgatgtgagggcatcgtatgcatccacaatggacacggcctgggcgcagatagggatggcatctccgtacagcccatccggatatcccctgccgtcccagcgctcatgatggtaccggcagatgttgtaggcgtactcgagataccccttatcgctcatacgttccaggccctccagaatctggcatcccctgagtgtatgggtcttcatgatttcaaactcttctacagtgaggcggcccggtttattaagtatcttatcttcaatggcaatcttgccgatatcgtgaagggccgaggccgaagcaatgacttcaatctttttcttatccagcccgtattcaggacaattcctgcacacctcctccaaaagcacctgggtcagcagacggatgcgcttgatatgctgtcctgactccagactcctgtattcaatgacagatgaaagggcatccaccagcacatcgttggactccctcagcttctgtgcctgctgttctaccatgtcctccagattatgtttgtgaagataaagctctatgatattatgtacccgccgcttgaccacatggggctcaaagggcttgacaatgatgtcggacgcccccaggtcaaaggccctcagctccccttccagggagttatcagccgtgattaccaccacaggaacttcgtccagaagcccgttggcccccatctcctgcagcaccttgtatccatccatcacaggcatcaccacatccagcagcatgatggctatattctcgtgatactgccgcagcagaagcagggcctgctccccattctcagcctccagcagatggtattcctcctggaacagtccatccagaatcacgcggtttatttccatatcatctacaatcagtatggtatcccgctgacgcatatcgtcacttcctctccgcagccgtaagacacatgctgccgctagtcatttgcaagtattctgcatatctccttgtaagccttttccagctccggatacgctccggcagcttcatcaaagcggtccgccctgatatggtccaccataaaagaggatatgttaaacagcctatccatacccaggttggccgtaactcccttaagggtatgggttgccatcagggcatcctccctgttctccccctcaaaggcctttgtaatctgggaaaaagtactgtctgtcaggaacttcttcagaaatttctcatacagtacggaattgccgctgaaacgccttaaagcgccctctatgtccacccccgcgccctttagttcaagtattgtatttaaatccatgaaaatccccctcattccggttctggtcacagaaaccgttctcaaatgaaaatgacgaaaaaaatataacatattgtataaattatagcaggttgaggataattgtgcaacgatatgaggaaattacagaacaagtgcggaacaagcggaagtttatgagaaacaaaaaaggaaccctgcctggaaggttcctatttctaaaatgcgggagatgggacttgaacccacacgagcatacacccacaagatccttagtcttgcctgtctgccaattccagcactcccgcaacacgaatggtagtatagcatagatttttcgacttggcaaccatttttgacaaatttttttaatttttttcaaaaatcaaattcgataaaaaatttaaaaaataatattgacaaatcgctattactcatttataataaccttcgttgcttgaacaaagcagcagaacaaaacaaaatgcagaagtggcggaattggcagacgcgcacggttcaggtccgtgtggtagtaataccttgtgggttcgactcccatcttctgcaggcagaaaacaggaatttccagtatggagattcctgtttttatgttcatttttctgcagcagaccggcccggcaccagacagtccggcaccgtcggcacatccggtccttctccggcccagcggccggccgccttttctgccgctgttacccatcttcgtcccgcgccttccgccgcgcccctccttttatgaatcccggcagcttccccctattccccatcccgttcaggaacatagggacatgtggttctgcgcacaatcaatgtagggtcaagtatcacccgttccggcttttcctgtggatttttcagctgttttaacatcagtctggcggcatgctcgctcatctccctgacatgctggctcaccgttgtcaagctgatgtcatagagtgacgaaaaaacaatattgtcgaaacttaccacggaaatctgttccggaatcttgactccggactcccggcagtgctcaacaaacccaatggccatcatatcgttggaaatcacgattccctttggacggttcttcaaatccgatatataaatctttgccagttcgcttcccgtgtccagcttcaaatcacccctgaatacattttgttccttaaaggggagacggtaattttccagcgcctgcctgtatcccctgaaccgctgctctgatgcggacgaaacatccggccccttcacaaaggcaatctccggataccccagctcaatgagatgcatggccgcaatataaccggccttgaaattgtccgacagtaccgaatccccttcataggaccccagaatcctgtttaccagtacaaccggaatctcaatattctctaattccttttcaatctcctctgattgggcagtaagcaaaaatacaccggaaaaattaaattggatagccatatgaatgaactctttttcccgcctgatatcatattcactgttcaggaccatcagcatatatccattgttgcgaagaatcttctggatgtaaaaggtaagatccgcataaaacggattgcggatgtcgctgacaatcagcgcaatgatgctttgtctgcccttgctcagacttctggctattgtatttggctgataacctatctcctccacaaaatccagcacctttttgcgcagctcctccccgacccccggcgagttattcatggctctggaaatagtggaacgcgatacccccagcatctgggccacgtcggaaatagtatacttatcttttttctggatactcattctcttacttccttatctgctttgaaataacatggctgtgatccacctatcccaataagcgtcttgctattattataatataagtaaaaatgtaatgcaatcggtattgcgataaacgaaaaaggaggagcagcccccagctgttcccccctttcgcccgtcatccttaattgaacggcgccggataaatggtatcgtgttttgcaatgtcaaacggccatacggtaacaagcgagccatcctggaactgagcgattgtcagcttgccgtccatattggtgttcttataaggaataccgttaaattcagactcggagaacttgatagtgtcataaggaagaataatctcctcgcctcccgggaaggcatctttaatctccagagtactcagctcatcctttaatgcttcagaggtaatctccttgcctgcgtctgcaagattctgaagagctgtcctgaaaatccagactaccgtgtacgcctccgcggaatgcccgttcatatcaacgccgtactttgccttaaacgcgtccgaaaccttggttcccttgtcaccaggcaggaattccgtggctgtaaggattccgtttgcaaggccgcccacagacggaagataagaggattccgtataaccgtttgccttggcaatcatgatattgggcttgtacccctgctcgttcatggtctttgtaaggagaatcgcgtccgatacataattgtcaacaataagggcgtccggattcagggactttaactgcagcacctcgctggtcaaatccgccgcgccctgggagtaaagaacctctcccttaaattccagtccgttctcttctgcaaagtattttgcccaggtggctgtctgctgtcctaattcggtattgtccgcgcagaccgcaacactcttgacgtcgatatcatccgccggatccttggccgacaaatccagaagatactgctccatatcacgtataaacatcatattggtgggagccaggcggaagaaatactcatatccgtgagaagtaagggaatccgacgtggcattggctgttatcatgggtacctggtagttttccgccacctgggacaccacctcggtaacaccgctctgatatgcgcccattaccgccatcaccttatcctgtgtaatcaaacgttccatctcagtcatgcccgtggcattggccccctgggtatcaccgtatacaatctggataggccggccgcttattcctcctgccgcgttgatttcctccactgccaggtcaatgccgtccttcatgttctggcccgaatcagccagcgctcccgtcatgggataaagcgcgccaatcagtatgggctccccatctgccgtggacgcctttgccggctccgccgccccgtcgctgcctgcagccgcggttgaagctgccgtccccgctgccgctgcctctgccgcatccttctgtcctcctgaaccagaaccatatcccccgcatccggacagcatacccgctgccatagccgcgcttaatgtcaatgccaccaattgtttcctcatgtatttctcctccttttatttgattaacccatataagggccatctttcatttttagtttgtttccgcagcagcaggaacacagctgccaaccgcgctctaaaatcccagatacgcctttttcacctcatcgttgttcaaaagctcttcggctgtgcccgatacggtaatctggccgttttcaatcacgtatcccctgttggcaatcctcagcgcctttctcacatcctgttccaccaggataatggtaagcccggattcctgcgccacctctttggcaatggaaaatatgttgtccacgatgttaggggccagtcccagggagggttcatccatgataagaagcttcggaagtcccatcatgcctctggaaaaggcaagcatctgctgttcacctccgcttaaggtgcctgccagctggttctttctgtctttcagcttaggaaaccagttatagatccgttcaatggtatccttcttagccgctttcgccgccttgctgctggctcccatctccagattctcatagattgtcatggaaggaaacagctgcctgccctccggaaccaggataaccccgtggtcaataaaggttctgcaagccgctccggtaagatcatgtccgtccaaacggatatttccctgaaagggcctgatcaggccggcgcaggacttaaccgtggtgctcttgcccgccccgttgcttcccaccagggctacgatttcccctttatccgccgtaaattcaatatcccaaagcacctgaatgtccccgtaccggacattgattttatttacctcaaaatatctgtctgccatatcaatgctcctccttaccaagataaatctcgatgacataggggtcattcattaccatctccggcgttccctctgttattttctcaccatgatgcataacaaccactttctggcagagattggccactgctctcattacatgctcaatcagcagtatggtggtcccgttctcattgattttgcgaatcagttccacggcctcatctgtctccgtgggatttaagccagccataacctcatccaatagcagcatatcaggatccgtggccagggccctggccagctccaggcgcttcttaaagggagtgcccatttctcccggcagccagtccttccgctcgtacaatccggtaaaatgcaggatttcctctgcgtattcctttgcctcttttactgatttatatttttttcttccatatagagcacctgaagcaacattatccaatacagacatggaagccagaggcttcatgatctggaatgtcctggcaattcccatggacgtgtagtgatatggcttcattccggtaatttctttatttttatagataatatggccggccgtaggcgggaacacgccgcttatcatattgaataccgttgtctttccggctccgttggaaccgataagcccggtaatgccgccctcctccacagcaaagctgacgctgtccacagccttcagtcctttgaaattcttactcaaatcctttatttccaatatattgcccacttaaaacgcctcctctcctgatttactttttaccgtccatcctgtcaaacatatcattgacctttaccttgaatttgctgccgttataccagcccataatacctcttggctggaacaggataaccacaatcagaatgatggcgtaaaccagcagattggctccgggcgctatactgctcagggtagagttgagatactgagctaaaggtgtaagaataatagctccaatcagggggcctgtcacgcttccgattcctccgatcactgccggaagaacgaattccacggactgtgcctgaatcatgatatccgggttaatgaaacggatataatttgcatagaacacaccgcatacagcaatcaggccgcagctgacaaaggtggccagcaccttatatttgagaggattgattccgattgcattggccgtgtcctcatcctccctcactgtctttaaggcatatccaaacttggaacggtcaattgcgcgcacaatcagatataccgctattaccataagaagggacagataaaaatagggcactttactcttaaatcgcagcagagccagggaattatcgccaaagggaagtaaaagcccctgccccttgccggcaaaatcccagttggtcatcagattgcggaacgcctctccaaacgcaatggtaaccagtgaaaaatacggccccctcagcacgaaacagggcgacagcagcaatgcggttaacgctcccacaaagagaaacaccagaggaatgctgatccacggcgatacattcagcttaaccagtaaaagagtggacatatatgcgcccagccccataaaggaggcatgtcccagggaaatctggcccgtcagcccgcccaggatactccaggccagggatgcgctggccatgtaaaatgtcatcacgcaaatcgacagcaggtacggtgtacggacaaatacgggtatcacagctgcgattagaagtaaaatcaataataaaatctgtctggaacctatttttttcttcattgctatctacccccgtcttgttttcactgtctgcttcactaccagaatcaatataaatgccaggaacacaatggtatccttaaaggaggaacccacaaccacggcacccactgtttccataagtcccaatacaatgccgctgacaaaggctccgataacgcttcccagtcctcccatggttaccacaatgaaggacctcgtcccatacacggcgccaaccgtagggaacacataataaaaggacatcagacaggctccggtgattccggcaatggctgctcccagaccgtatgtagtggcatagaccagctttgttttgataccgcagacctgggctccggtactgttctgggaagtggcgcgaatctgcttccctatattggtatactttaagaaagcaaacaaaaggatggttaccgccagaagaatcacaaagctcagcaccttgggaaggcttaagtttatggctcccagctgcacgattttctcggaaaacatactctgggccgttctgtaatccgatttaaaataaagaagcgctacattctggaacagaattcccagtccaaccgttaaaaacagcacattggtatcgtcattgccgtgcagggaccgggtaatcagcgttgactgcaaaagcgccccaaaggcgaacatcaccaccgccacaatggggattgccacaaaggggtcaagaccgcattggtcaaacagaacaaaggatatgtacatacccagcatcagcagctcgccctggcaaaaattgataatcttcataactccgaaaatcagcgtcaggctcatacctatcagtgcataaattccgcccaccataatcccattggcagctgcctgcaaaaatatattcatgttactacctcccaactaatttgataacagctccgtgttcacgaacacgtttccacccgtttctaccttcccaaaaaacctccgtctaccggtataactgccccggatatataagcagaggcatcggaagccaaaaacacagccagccccttaagatcctccgcagtcccccatcttcccatgggtatcctgcgggtggtttcctcgtattgggcaggattctttaccttcatggtatctgtcagagccgtggccatgtatccgggggcaatggcattgacattgattccttctgccgcccactcatttgataatgcttttgtcagctgggcaaccccgcctttgctggcactgtaggccggaaccagaacactgccaaaaaaggaatccatggatgctatgttgataatctttccgtaacggcgggccgccatagaccttccaattctctgagacatgaagaacacggcgttcagattaagttccaacacttcattccaatcctcctgcgtcacctcaaaagcggcacatctgtttaatgttccggccgcattaaccaggatatcaacacgtccattgtaaatctccaaaatctgctcacagacagtttcccgctgctgctgcctgcttaaatctcctgtcactccataagccggaggtccgctgcttcctatttctgcggcagcttcccacacattcccggtcctgccggttatgattacctctgcacctgaatcgtgcagcgcctgggcaattccatatcccagtccacggctgcctcctgtgacaaccgcccggcgtccttctaaatcaagtatcattatcttccgtcttccccctttctttccctgtatctcaacgaatcaatcccctccttttgcatcatacagtttgtgtccgccaaccgtaattagcgaatcagtttcgtaatgtttcgttctttttagaaaacagtttcgttacgttgttccaagcatagcacacggtttcgttaaaatcaataagtttattcttgtttttctcttgttttaatgcttttttactattttgacaaattttcagtatatatattgtctatttttcaaaaattgtttattttttatcaatgttattgtgcatatggtcagattttgcccctttttaatctggctcatctcttcactaaatgtacaatatgcataatattttttacgtatttttatatttcattgtctccattataatagaatgccaaaaacaaacatatttttgttattgactattgaatcattttcgtttactattagccttaaagaacgaaatcggtttctctaatacacgggggtattaattatgattaacggaacaactctttggaatcgctcttatacttcagatatgatagaaaagaccttttccggtaagacttatttgacctatcccaatcttcctgccaatttatacgacgccctatccttatctgccgcacgccatccggacaagacagcagttgtggatgacagcggcgctgcttatacctatacagaactaagggacatggccgaccatttttcttcttacctatattacatatcggatatcaagccgggaaccaagacaggcatcatgatgttcaacagtgttgaattctgcgtgaccttcctggctcttacaaaactgggagccgtggtaatacccctacccagcaaatacagccggaacgaagtgctttcgctgacagcaaaggcagatctccagtacatcctgtgtgatgaaaagttttatgactggttcgtaccgctggaaacctccggcgtccatctgatgaagcccggacggagtcaggacggatttggtttttcccacctgtgcgcctcctatctcagccccgttccctcccttggcagggaggaggatgacgcgctcatcatgttcacatccggcaccacctcccagagcaagggagtcattatcaagaattacagcatcatgcacgccattgtctcctaccagagaattttccagataacggaccgggacaccacccttatacccattcccatctacctggtaaccgggctggtggcgcttctgggactgaccctgtatgcaggcggaaccgtttacctgcacaagttctttgatgccaaaagggttctcagggatgtaaacgacaaggaaatcacatttctccacgccgcaccggccgtattttccctgctgctgagggagaaggacagttttccttccctgcccagtctgaggcttttggcctgcggaagcagcaacatgtcaaaggaaaagctgacagaaatccaccgctggctgccctgcgccgtatttcacactgtatacgggctgaccgagacatgttcgcctgccaccatctttccgggcgatgcttccaccagcagttacattggttcctcaggccttcccattcccggcacctgcttttgtatactggatgactcaggttcacagatgcagacaggccaggtaggggaaatcgcagtcagggggacggttctcctggaccggtattatcaaaagggaaccggggagctggacggagacggctggctccgtaccggagatctgggatattttaacggggaggggtatctgtttatcgtggaccgaaaaaaggacatgataaaccggggcggagaaaaaatatggagctttgatgttgaaaatgagctgtacaggctggacgggattgatgaggcggctgtggtggggattccccacgatatatacggcgaagtgcctgtggccgcggtgaagctgtctcctgaaagcattctgacggaacagcagatacaggatttgctgaaatgcaggattgccaaatacatgattccttcccgcattcttttcctgaacgagctccctctcacgcccaataacaaagtaaataaatcagccatacggaaacttttcatgcagccagaacagtaaggaggttacacaaaaatgagaaaaccagtttttatcaccggcgaggaagccgctgccatgattgccgacaacgcaaccgtggcaaccattggtatgaccctggtgtcggcagccgaaaccattctcaaagccattgaacagcgctttttagagacaggaagtcccagagggctgactctggtccattcctgcgggcagagcgaccgcgaccggggtatccagcattttgcccatgagaccatgctctccagaatcatcgggggccactggggactgcagcccagaatgatgcagctgattgcggacaacaagattctggcctactgcattccccagggccagtttgcccagttataccgcagcatggccggaggcgagcccggaaaaattaccaaggtgggcctgggcaccttcatcgaccccaggattgacggaggaaaaatgaacgaaatcaccatgagcgctcccgatatcaatgaggtggttaccatcggcggcgaggaatatatgcgctataaacccattcctctggattactgcatcatccggggaacctatgtggatgaatacggcaatctgaccacagacgaggaggccatgcagctggaagtgttctccgccgtcatggcatgcaaaaaattcggcggaaaggtgctggcccaggcaaagtataaagtcaaggccggttccctccactgcaaacgcgtgattgtgccaggggtattcattgatgcggttgtcatctgtcccaatcccgaagaggaccacaggcagacccacagtttctatatggaccctgcctactgcggagataccaaagcgcctgtatcatccgacgacgtcctccccatctcgctgcgcaaggttatcgggcgcagggcattgatggagctggcgcccgatgatgtgctgaatgtgggaaccgggattcccaatgatgtcgtcggccccattatcacagaggaggggatgtcggaggatgtgaccataaccgtggaatccggtatctacggtggcattcccatgggcggtatcgactttggaatagccagaaaccagtttgccctggtccggcacgacgaccagtttgactattataacggacccggcgtggatgtcacctacatgggtgcaggcgaggtggacgccgagggaaatgtcaatgccacccgtttagggccaaagcccacgggagcaggcggttttattgatattaccaccaatgccaagcacgtggtcttctgctcctcctttaccgccaaaggactggactgctcctttgaaggaggaaggcttcatatcaaccaggaaggctctttaattaaatttgtcagccggattaagcaggtttcctataacggcagaatcgccagagaaaagggccagaaaatgcactatgtaacggaacgggccgtatttgagcttcgtccggagggactgaccctaaccgaaatcgcccccggaattgatattcagacccaggtcctggacctgatggaattcactcccctgatcagccctgatctgaaggagatggacacagccattttcatggagggtgctcccttcggactgagaaagtatatattttctaattaatacgcagcagttcgggacggtcaggatgggactccgtcctggacagttccaataacatattcacattaaggaggattaatcatgagactcgaaaacaaaaccgcaattgtaacaggtgccggccgcggcctcggcaaagggattgccttaaaactggcagcagaaggcgccaaggtcatcgtagccgacatgtcaatggaaacagcctctgcaaccgctgaggaaatcaacgcttccggcggcacagccaaggcctttgccgtcaatatcgccaagcaggacgaggtaaaggcaatgatggactttaccgtagagtctttcggcacattggatgttattgtcaacaacgccggaatcaaccgcgacgccatgctgcacaagatgactgtggagcagtgggatcaggtcattgcggttaacctgaccggcacattctactgcgtccagtatgctgcccagattatgagggaaaagggaagcggcgccatcatcaacatctcctccgccagctggctggggaatatcggacaggccaattatgccgcctccaaagccggtgtggtgggcctcaccaagacagcatgccgcgagctggcaagaaagggcgtcacctgcaatgccatctgccccggttttatcgacacggacatgacccgcggcgtgcctgaaaaggtatgggataccatgataagcaagattcctatgggaagggccggcagccctgcggacgtagccaatatggttgctttcctggcttctgacgaggcaaactacataacaggcgaagtaatcaacgtgggcggcggtatgattctttaatgatataaaatgaggaggatacggatatggagaatttaaaagaagtagtaattgtcagcggagtccggcttcccgtcggctctttcggcggaagcctcaaggatatttccgccattgatatgggcgccatggttgtaaaagaggccgtgaagcgtgccggtatagagccctctgatgtagatgagactatcgtgggccaggtgggccagattgcggaatgcggttttgtagccagagccgtcagcctgaaggccgggcttcccgaaacaacatgcgcctattccgtcaaccgccagtgcggctcaggccttcaggccattgccgacgcagtgatggagatacagacagggtttgcagacgtggtggttgctgcgggcaccgagaacatttcccagcttccctactatgtgaaggacgcccgctggggtgccaggatgggacacaaggtgtttgaggacggcgtcattgatatattgacctggcccttaggcccctaccacaatggcgtgacagctgaaaatgtagcagaaaaatacaatgtgacccgccaggagcaggaccagtatgccctggaaagccacctgagggcagcggcagccatcgaagcaggtaagttcaaagacgaaatcctcccggtggaattaaaggacagaaaaggaaacatcactgtctttgacactgacgaaggccccagagccagccagaccatagaaaagctggagcgcttaaaaccatgttttgtgaagggcggaaccgtgactgcgggtaattcctccagtctgaacgacggcgctgccgctgtggttgtcatgtccagggaaaaggcagacgccctgggtgtcaagcctctccttaccattaagggctgcacggttgccggcaacgacggagccgtcatgggatacgctcctaagctctccagtgaaaagctggcagcgaaactgggattggaccttaaggccattgatatgtttgaaatcaacgaggcttttgcaagccaggcctttgccgtacgccgcgacctgggactggaccccgaaaaagtaaatatttacggcggaggaatctccatcggccatcccatcggagcaaccggtgttatcctggccgtgaaggtactttatgaactgcagcggaccgataaaaaggacgccatggtaagcatgtgcattggcggcgggcagggaatctccatgtactttacaaaagactgatactaggaattaaaaccggagctgaaatctgtgttagaggatttcagctccggtttgttttgaaccgcagtaaaaatgttactatatctaatgatcaaatcacctgaacatctgcagataataccagggaggaaacagcctgcccacctggtccagtcccggaaagaacctccctgcatccacaaaaacaggacagaacacaaggcttccgataagcaggaagggtatgatgcagcagagaacctggggcctgcggcacaccaggcgcagaatccaggccgatgctatgacaacacagcagtaaccggccatggccgcagcctctcttggaaaggatgtcatcacgccgcccgcccacaaggccagaagccctgatatgctgaccatgacggcaggagccgccatggaagccacgcggcagggtatcctgtatccgtatgaaaggggaagaaacaatcccctctcctcatcgccacacatgaccacagccccatacagcccggtaatgaacacataaacagccaccaggcctctgaccggaaatacatctgtctgaccgccgtcaaaatccatgttctccccttcccggccctggaactggtactggaaccggaaggtggaaccattgcccagccatttttcatacagctcccgggcctgtacggctgcttcctccctggcttcgccgcctggtgctcccagtggggcaaacagttcattttcagccacataatccgccagtaatttcccatcgtatatcttcataagggctgcaaacacagtctccgtggagagagccgcagccacggtggacggcgccgaatatacgccgatggaacgtttataggatttggtatccagcctctcctccagtccggcatataccacataaccgcactccgcccgccgggacgccacttctgcctttacctcctcctcgtcacggcacagatagaagcggaacattcccgcatcctctcctctcggccggttcacaaggctgtccgccagggcatcacccagcgtgttctccccgctctcttccacactgatggctatgcttatgtcctggcttccctttttctgggcctggccggctgccagcaccccggcgggaaggagcaggaggatgaaaagaaaggaccattttctcatatatcgtttgcatgacagaaaaaaccacatagcgacccgcttcattccctgaccacctccgctcccacactgagcagaaacccggccatggccaggactgccagctttataaatactgccaggctaaaagaagatgtgaccaccagcttcatgccctccatcagcacataggtgggcagaaacggcgctgcagcccggaaggtggtgggcaggaataccaggggaagaaatcccccggacaaaaagtgcatggcagtcaccgccagaaacagcagcatgacaccgcccatcaggcttccggccgcctggtagaggaacaccaccagggacgcagcccccaggcagaccatcaccagggctgccagcccgggcaggctgaattctatcagccccgcaaaagacgctcccagggccgtacacagggccaccgacagaaacagcatccccacccctaaaatcctggctgcaaccagagtccccttccccactcctataagggccagctgacccttcatggacgcagagccggaggcaagataggctgatacgggaatggcgcagagaagcagaaacagtacagccgtgctgatgccgtaaaagtgaatcgtatccacgtcccctgtggcgctgactcttatattcttaaagtagtccatgcgcggcaggctgtaacccatataaatccggttcaggtccgcctccaggccgctcaccgaatccgccatgccgtaaaggtacagcagttcgtcccccgcgtagattcccgcctggctggctcccagagtagaggcacctgcatcagtcagttctttgaaaatgcggctttccagacccactccctttggcagcagaatttttaccggagtattggttccattcataatatcctgcacaaatccctccggcacctccatcactgcgtacagttttcctgctttcagcttatccaggcattcttctttattcatatattcaaaatcgcagatgctcttgacgctttccagcgaactgaccatggccagtgccttcttcgccacagcatcgccttcaggaagcactacccctacggtaatcctccctgacgatgtttccccatacagcatcctggctgacaaaagggcaatcgtacccgctaaaagtaacagcacgattgcccctgcaaagatgtggggaagctttttacatgctcgtttcaactcaagcctgagataaaccagacgtgcagacatatcttcccattccttttatcttattaatacatggatactcccatctggctgcctaatcccatgacgccaaacagcatttccatccctacattggtccaatcctcttccgtggcagacagcacatccatagtctcgccctctaaaggactgatttcgccttccagcggctgatagtagtattcaccgctgagaaccacattcacggaattatccataatggatgtctccagagaatcaatgttcacatggacggattttcccttttccagctggtccactgcgcctgtagcggaaatcttcacaagctgtgagccatttcctcctacctcgcccgacaggtggtagcttccatccttggaatcatatgtactggtgtatgtaaagttatatgtctcatcaccgggaacagtcaaatccagggaaaggtcgctggtcagcacgctcttatcgtaggttccctgcttcaccatatcaatgctcaccgtatccgtggcatcctccagcgtaatgctggccagggcattctgagtcagataggcgccgccctgaagctggcagctaaaggtcactgcaatatatccctcttcggaaacatctgtattctccacatagagattggtggagccttccactgctgccaggcgtcccttcttatccacataaaccgtcatgtttacatcggtcagcgccttgtccagatattctatcatctgatccaccagtttctttgcctcctcgtaggactgctgctgcatctcctccgcggacatagttccggtccctgacatggttccgcccataagctcgctcatcttaacggtagtctccagctgacgcataaaatctgctttcagggtctcatcctgaaggaagaaatcagaggactgacgaaggaattcaatcatggaatccttgctgacagttacattatatcccttgcagcttacctgggcgccgtctatggtgtaggttcccttagcggccttttcaactgtcagggcagccttgaaattctcctgggccttgcatccttctttataacggttaatcagcgcctccacgtcaaagggctgtctgccttctgtctgtgctttttcagcctcgtccatcagctctgtgaaataaacagccatgccttccacatccacgccgttctgctccagcagaggtcccacggtaggcgaattcttaatacgctctgccagtccctctcccaggtccacggtaaacaccttggcggacagctccggaaccgcaagcatcagggtatcatccccataatatgcgttcagattggcaaggtccatgccgctgtagataactcccatgttgaagaagctcctgccgttggtcttgtcgtcctttgcctcaaagcgcaggccgcttcctgcataagcattgaccgtcgcatccgagcagctgtccatcttaagtgtcaggccgccctggctgtctgctgtcttcactgtctcagcaaagtccttcaggccgaacagctcctcagaagggtaaacctgtccttccgggaatacattttcaaaagcgtcaatgaccacctgcttaggatcctttgtggtcatcttcacataggccagcgctgcaacggcaatgacagcggcaatagcgacgaccgcagccaatatcttgataaacttcttatttggctggggctcttccggcacagtcactgctgccggagccgtttcctctgcttttacattctctgcttcggccgccgtttcctctgcttttactgtctccgcttcggccgcatgttcctctgcttttactgcctctgcgccggatgccggttcttccgactttactgcctccgcgccggacgccggttccttgtctgccggctccgggccgttgttttccggtgtctgatcctcatgttccatcggagccccgcactgggtacagaatttcacatctgcttcctgctctgctccacatttggtacatttcatatttctctctcctcccttgtaaaaggatccttccgctgccttaaatgctgctgcggctgtccttttgttatgaatctatcgaaattggctaatcagctcttttgccgacagtccacattcgatttcccttaaaactccgccttttagtatgcacatcctggtacacaaggccagctccgccagctcatgggacgtcagtataacagccccgcccgaagccatatattccctgagataattccggataatttccttacactccaaatccagggcagcccccggctcatccataataagaacaggagcatggttggacagggcgcatgctatgctgagccgcttcttcatcccgccggaaagctttcccgctgtacgatccagcatgcggtccacacccagcatggaagctgctccgtcctttaaatccgattccatctgctttctgcttcccctgtaccacaatagcaggttgtcccttactgtcagttcctccataagaggattctcctggggcacataagccgcctcctccgcaaatacccgcggatggcccgacgcctccctgccgttatataagatgctgccccggtccgctttctgagcacctgccagaatggacaaaagagtcgtcttgccgcagccgttataccccacaatgcccacacattctcccggagccactgtcaggtccgctcccgctaaaatattctgtctgtgataggacttataaattcctgatatctccagcatcgccgcaatcactcccgtaaaaacaatatatgatacaggactcagtgtaccatatattgggagggaatgcaaaataataattattaacgattccttaactataccataatgacagtaacgttttttcgttgttttcaacgttatctgtaatgttttagtactgtttttttaatgtttctgtatcgggtacgcaggcaaattcacagctggcaatatgtggatttggcggaaaaaccaaatgcaatacggaaaggtaccttctcccgaatattttccgccaatcatacaaaaactactatggaaaggaggtatcatcatggcaaaagcaggaatgagaagacccagcccttacgacgcagataatcacggaaccgagaaccaccacaaaatgaaccatcccaaaaatgagcaggcccaggttcccgaaatccagggggctgccaaaaacggaaacgccaaagcaggccctatcaatgctcccaactgggctagagacgattataaaacaggagagcattaaaggcacattcatcccatttaacctaatgcccccagctccgccgccctgtacagcgccgccacatgcacggcctgttctaccccgccttccctcagcaaacgcttcacttcctccccctccagctccactacctccagggcctctgtctcatccaggttctgggctgcggccgggaatacattcctggccaggtagcactgggcatagctggtgcagttgctggcattcggggcgattttgaagaggaattccagactccctgccttgtatccggtttcctccagcagttctctggcagccccgtcctttggatcctctcctgcctcgatgcatcccgccggaagctccaaaagcaccttctccacgccgtggcggtactggcgcaccattatcaccctgtgctccggcgttaccgccaccaccaccgcaaaatccggcagatgattgacgtaaaagggggcaatgaccatgccgcccggcagctggcaggtgctggcgcgcatatcaatccatgaatccttgattacagttgtctcatccagtattttccatgaaagattcatattcaatttttcatctttattatccgccttcttcattgtccctctttttctcccttactttcctgcgccctgcacagcaggccttttcgtgaacagcctcactgccataacccgtcctccagggccgccatcatcaggaccagatgcaggttcatggctgctgtcttgtcgtcaatatagtggacatcccgctccatcttcacccgccccggcagcagttccattgcatcaaacaggtcctttgccgctttccgcgactggtattgtacatatgcatccttaatcattgcccacaacctcctttggttattataacgcttggaggctgctttttcccttattttctgccgcgaaaccgccgggtatacccggctttcaccgcattattctcctgctgacaggctgtttcccaccataccggccacaatcactgcgattccggccagtcccgccggctccggaaccctgtcctttagcagcaggattcctcccaacagggtaaataccacctcaccgcactgggtagcctctatcactgccagatggcgcggattttccttaaccagatccgtggccttaaagaacaggaccgtggcaataacacctgaaaacagagccacacacagggactggaatacctgtccgcggtctgccggtccttcttttacccaggcccagccagacataaaaatccaaaagggcatgctgcacagtgtcatgccgtaaacccgttccagagtcgtcatgcctgccgggcaaagcgccatcattttacggttccccagaggataggaaaatgccgccaccagtattggcaccagcgtaaagagcacagtcctcacctccatccgcttcagatgaggcacctgcatcataaatacgcctgccagaacgagaacagaccatcccagattccgtatcggtattctttttccaaatagcggcgtcaaaagcacgccagccactatggtcagctgccaggtcgctgcggccagccaggattcccccaacacagagccaaaggtaagaggcgcgtaaaacagcccgaatcccaccgtactccataccagccatgagacaggcgcctcctttacagcgctccacaccctggccggcgaggggctcccagccagcatgatccgcaatatgggaaatgtaaacagatacctgaggctggccgcccacatccagtatcctccggccagattcatgcttctgttcaggataaaggtaaacgcaaagaaaaaggatgccagaatcccgtatatcagcgctttcttcaactcattctcctcccttttttgaaacagccgcgaaaagtccgtttcaaaaaagagggcactgcagcttgtcctgcaataccctcttgtaatcctatatcaattctaagttaagcaattttggacttagccagttcagctaactttgcaaatccctctgcgtcattgatagccatttcagacagaaccttacggtttaagtcaacctcagctaactttaagccgtacatgaacttgctgtaggacaggccgttgatacgtgctgcagcgttgatacgtgcaatccacagctgtctgaactgtctctttctctcttttctgcctgcataggagctggtcagggcacgcattacagactgctttgcaatcctgtactgcttggaacgggcgcctctgtagcccttagccatctttaagactctattgtgtttcttctttgcatttaaaccgccttttattcttgccatcggtaattcctccttctacaattcaaacttacagatatggtaaaatcttcttcattacctttgagttggtagcatcggtaacgatatcttttctaagatttctcttcctcttagtggatttcttagttaagatgtgagacttgtaagctttattgcggactaacttaccggttcctgtctttttaaagcgctttgctgctgctctgctggtttttaactttggcattgtaaatttcctccttaaaactttctattttaacgttttgcagttaaaaacataaccatgcttcttccttcaactttggagggtttatctataactgcgatatcctttaaactctcagcgaaatcatccaggatgtatttggacttgaacatatgggccatctcacgaccgcggaaacgaagtgtcaccttcactttgtcgcccttctccaaaaactttctggcagctcccaccttggtgttcaggtcgttggtgtcaatgttgggtgacaaacgaacttcctttatctcgattaccttctgtttcttcttggcttctttttccttgcgtgccagttcataacggtacttgccatagtcgataatcttacataccggtggctttgccgtaggcgcaatcttcaccaggtcaagctctgcttcctgagccatcctcagtgcctcttttcccggcacgatgcctaactgctccccgtcctcgccaatcagccgtacttccttgtctctgatttgctcgttaatcattaattcgctaatagtcgtacacctccaaataagtcatgttgttctggaatcggcatgccccgttctttccctgtagggcaaaaaataaagcggacagcctggctatccacttcctcatataaaaccatctgctgccctatctcacccggatacccccggaaataatacagcacatcgtttcatctatgaacccgggtcacttgttcgtgccagggtgaggcggatacctgctttcctgtcagtcgttctcacaacttatattaatctactacatttgatcgtatttgtcaactctaattttaaaatttttcctatgatttcttataatgctttacttctaaacctttataaccccttctccagtcttccgcaaaagggcggggacgtcttccggttccccgtaagacgtccccgcccggcctgtcctgattctgaatctatctggccttaaaggtactgcacctggtctccgtgcactcgcaggctccgtcaccgcttatatcaatgcgctcagcgctgcagcggtgttcttcgttgtagacacattttactgcgtcgcaggcaatctccagccttgtctcaggggtcttgaacaggttggtgaacttgcctcccttgttctcgtcaaagcttgcacagcaggtctgctctgctgtcttggccttgttgccgtccactgcaatggctgccttgcagcagcagttatcagcgttgtgcaggcagttctttacactacattccagcttggtcatcgtccttacctccttctcctggtcttcattcttaccaatgacaaggatagtatgtgcggattatagtttttgattcataagccgcagggcttcaatgcattttccttcactgccgtccatattataaagctctcccctggtcacaaaggtatatacctggatgtcgtccacataggcgcctttgccgccgcttacgctgatggtaacatcagaaggctggcagttgctgaatttaagctctaccttccgctcctccttcacgtccacggtccttgtctgggatcccatgcgtatggtcagcctgcatttttcctctgcccctgtcctcagcttcacataggtatccttgcctgtgttgccggtcatccggccgcccaggttctggtatatattcccgcccgacggaatcattgcggattttccggtctcatcctccgcaatgtagcttcctccggaaaaacgccatccttccataccaagggcaaactgggcattgaacagcttattgtccccgtaatcccgataggtccagatgccgtaccccatggtggaatctttaagaatgggagcaacgccttccagatacaatgatttctcatcatccctcagctgggcattgtgctcgtatccaactgtattgtccgtaaacaggaactggtccagatacacaggcttgcctccgctgtacacatgaagccggttcaggaatacgggaatcttttccagtgcttccgctgccgtcacgcgctcatgctcattcataaagcccatgggaatgccgtacattgcgctggtataggcggcgctgccgctggggaaggtggaggaatgcataaagccctcctggcttccgtccttgtgatccaccgggtccacatccaggcgcacttccatggacaggccgggaaacaccgtctggctgtcagccagaagttcatttaaaaactggtcgtaaaacccgtaaaatacacttctggcctgggaatccttagccggaaaatacaggtcgtcataaccggacagctcatggccgtacatttcctccagttcctccagctcataattttccatggcgtaatccacatatccgaaggctttggccatgctgcgcccctttaccccgtttcccagggacgcgctggaatccgtaaagttccagaagtcctcccatgtcaggaaccctccgcagaaattctcatgggaggacgccgcctggtacaggcggcccacatattccagccaggcagaccgctctgtcccctcctgcatcagcccctggtaccggtccatcacattgccgcccccgcagtaatcccaggtatatcccaccctcagcatcacactcagtccctgggcggcagctgcatccataacacggtccagcttgtcccaggcatattggttgtatgtacagggggtcatgccgggctggaattccctccagggcaccaccaggataatattgttaaagccgtcctgggcaatgcgggccagctcctggtccatattgccactctcgctgttccagaaattgatgacccagtcatcggaataataggtggctgatttgaggtaaccagctgtccccgcagcatggtcctctgccctggcaaacccggatgtaaacaggaacgctgccgcccccagtataaccgcggccttcatacatggtcttttcattggttctttctcctttagctgtggttcttttctccgcctcgtttcagctcaggccacacagtgagcagcatggtcccaaagcaggcggcgcccccgataaagttggatatgggctctgccatcagtatgccctgggttcccattccgaatacagtgggcagtatgatgataaggggtatgacaatgataaccttgcggaaaatggaaaaaaataccgcgtttctggattttcccagtcccacaaacacggactggcccgcaaactgaagggacatcatgaaaaatccaaagaaatacatgcgtatagccggaattcccgcctccaccatgtcgccctcccggttgaagatgcggataaagaacgccggaaaccagtccacgaatccccatgccacaactgtatacaggatacagaccacggacatgaatacaatggccttctgtacccttttatactccctggctccgtagttataccccagcacaggctgggcactgttggtcaggccgtttaccggcatggaaataacctccctgaccgagttgattacggtcatgattcccacatagaggtcgccgccgaatttctggagcatggaattatacataatctgtacaagactgtttgtgatggacatggtaaatccggacattcccaggcccacgatgcgaagcagccggccggcgtccagcttcatggccgaaggccgaagcttcagtatggtccgcctgcccgtgaggaaggccagaatccatagggccgacagcatctgggaaagaatggttgccagggcagcgccccttacccccatgtggaaaacaaagataaaaacaggatccagtacaatattggtgaccgcccccaaaagcacggtcatcatacccacggtcccaaagccctgggaattgataaagctgttcatgcccagacctgtcataacaaaaatattgcccatgagatagatcgtcacataagcgtctgcgtagggtatggtggcgtcgctggcgccaaagagatacagcatgggccgcttgaacatcaggcccagaaccgtcagcaggattcccactgccaccatcatcacaaaggaattgcccatgatggcctccgcttctttctcgttcccccttcccctttcaatggagcacagaggagctccgcccatgccgaaaaggttggcaaaggcaatcacaatggatatgatgggcaggcagagccccagccctgtgagggagagggttgcattctccggtatcattcctatataaatgcggtccacgatgttatacagcacattgatgagctgcgccagggtcatggggaccgccagcttcatgatatttcccaccacactgcccctggaaaaatcgtttttcttctgattgtccgattgtttgtccgtttgattatccgactgtttcatactcccaccacatttccatacattctgtctgttttgacccggccgcaccaaatatacctggaaaatgctgccggcaatgtctataccgcgcccaaatcctctgttcggtcaatgtccttaagttcttcctccggcacctccatggtccacacatccccggggtgcgccttcataattacgcttcctcccctgtcgccgcgaagtcccataagttctttcctgtaaaagctgctgaaaacagcgggatttccccgccgtccctgatggcacacacagcccatgcccttccctgacagccggaaaccatgtatgaattccttcagggtgggcgtactcatatatggctggtcggccactgaaaacagaagggcctctgattcaggagaggccgatgaagtccctaatctgagagaggcggtgattccctcaccgctgaatctgttgggaactgccagaagtccccgtctctcagcctgctttaaaatcgcctcatactggctgaccaccagaacctctgtctggtgcccctctttctccagctcccctgccgcctggcagatgcagtcaagaccatggcggtaaagttcttttcccttaaagggtaccagcagcttattagagccaaaacggcttccaaatccggaagccatatagataaatgaaatcctcattccccttaaccatcctttaaaataaccgggcggagccgtccttgtcaagatgtccgcatgcaatccctgatgtctctcccatgcaatccagcatttctccggccagcgctgcttcctgcggggtgtcggcctggttgaatacaggcaggacctcggttcccggatgggctgcccgcagaggcagcagatatccatgcttcatcagtgtcatcatatcttctttttgtatgatccagtctgccttatgctttgcgttcagctccaatgcatctgtcccgctgtcccgatgctcccggctatcctcatacatcttccggccatatcgtttcatcagatccacggcctcctcaagcctcaggcagcagtcctcagcccgctttccaagggatgtcaggccattgagacataaaatcatatctgtattgtccggtatcaccggctctccggccctcggcaccttcaaaggcaggcgcctggagccgtcggcctccaccagcaccaagtccgccagggaacaggcttctttatataattcccagcctgtaaatgtaatttttcccttctctgccggccttccggctaccgccaggccgcggcgttccagaacagtcctgatttcttctgcattgccgtcaaatactccgaacgcaccggggcgggccatatgggtcgtagtaaccaccaggaccttaagtccccgtcccacggcctcccaggccagtctgcggatagtggatgtcttgccgcccgctcctgcaagagataccacaaaagggcccggtcctttcccggaccgtgcctgctttatccgtccattaagccccaggccatgccacaggctgtctgttccggtccatatgccgcactggtaaaaataagccctcatggcaatttctccatttttacagttaatgcaaacccttattttgatactttgactattttatcataaaacaatggattgggaaagatgattttcccttccattcaaaactcacatccaaaaattatcattcaaaaacagccggaaacaaaggacatcccctgcttccggctgctgttctattcctgcattctattcctgctgttctatctctgctggattttatcctgcccggccttactccggccttacttcggccttgcccgggccttattccatccttaccctgtccttatttctggatgttattcctgatcacaccatacaaatcaaaactcaggataccaaacactaatataactccgatgactgccataactgattccttcctttcaaaatgttttccatcactgtgatagattcattatatgtcaggcagaccggttgcgcaatccgcattatatctaatcttttggtgaacacccatttgttttttgtgcatgaatgcaaaatattttagattgcctaaaaatttttgtatttatttctttttacccatcctgtcagctctgcgggcgatcagttcccctgctatgctgatggcaatttccgccggagtctctgctcctatgtccgtgccgataggcatatggcacttttggatttcctccagggagaagccgtccgccagcagcttatccgtcaccacccgtatcttgttcctgcttcccatgattccgatgtaataaggatgcagagccatggcctgcttctgcacgtaataatcaaactggtgccctctggtcatgacgcacacatagtctctggaacggatatccacataatcgctgatatgttccatatcccccaccacggtcctctctgcctgcaaaaacacctggggattggcaaacgcctccctgtcatccataaccacgcagcggaatcccacatgggccagcaccggaaccagctcctgggccacatgaccgcctccgaatatatagacagtcccggcctgtaccaggggctcgatataaaactttcgtccatccacttccttctggagagcattgctgccgaaaagttccccctctaacagttgtcccagccccttaataccggacagccccagactggggctgtaaaggcccatctgccagcatgtctcgtcggtgatatccagtataagccagctgtcctcatcctttgagagggcatccaggacctggccgcagaaaccggtcagcacctggtcgccgggacggatgtactggaaatataccaccacatttcctccgcacaccattccgatatccgccacctggttcctggtaagtgtgaagcctttggcaaaggaagccttgtcctccatggccttaagggctgcctgtattgcctggtactccacggcgcctccgcctacggttccttctatggacccgtccttccttaccagcatccgggatccggttcccctgggagtggagccggaactggcaatgatagtcaccaggacagcttcctccccctgttccaataattgtcttaactctgtaaataatgttttcatgactccgtctcttcctccccggtaaaatattttttgtaaagccgctccccctccatgcgcagttccctttccatccgcaggtagcggtccagaaaaaccttagacttgggcgtaagctgtgaaaatcctccctccgcccctcctgactgtgtaatcagcagcgggtagcccagctgccgctccgcctcttttaaaatcttccatcctttggtataggacatatgcatctgcctgcaggctgtctgcatggagcctgtgtggtcgatcagagacaggaattgggctgcctggggtccgaaaaacccttcattgcgctccaatgtcagctgtacctggggatatacggccagcttttccctgcccaggctgcccagggcacagtcctcgtccgattccacggccatgataatcccctcatcctccaccggaatttcttccagctgcccattgatttccggctgccgcagggcccctctgagtcccctctcgccgtgatagaccaaaagagacggaatggctgccttggacaccagaaccggatggccccgtttcccgttatatacaggacaggcggccatggcccgggaccccatcatccgctgtatggtgtccggaaggaacatggggaatttggcaggcaggataaataccctgtcgcataaatcctctatataatttaaccccatacagatgctgtaatacatctgagtctgctcataatcctggttgcgcaggcagatgacccgcagtccggcaatatgcttttccacctcgtccgccttctgccctgtaatcactaccaccggatcgattcccgcccgtttcagtgtgatgatgattcttcgtataaccgtgctgtcccccacgggaagcatgggctgaaaacggctgattgtgctcttgtggcctgctgcgataatgacagcccctgtcttcataagtctgttccgcctttcctggtatattaacagtctggtatgcgcccctaaagttctcctgtcaggagcaaaagagcggagggctccaccctgagccaccggggaaccactcccgccgtatcgtgggtgtggatatccttctccttcttccaccacaaaccattctgtaaagtaatataccactcaaacggcatttcggaaatacatggagcgcatacttttataagatttgcgtcttcccgctccatataagccctggcactgctctccgacagtggttcaaaatcatgggccctgatgcccacgcctgttatgtcatcgcccacgggacggtccgtggccagctccagcccatcccagtccacggcccgtatcctgcgttcccccagccgttcaatcctggatatgttcttacatcccgtaagcctggcagcccggcatgtgaccgggttctggaagatatcccgtgtccttccggctgccagcacgcatccccggtccatgagcagcagattgtcgcagagctggtaggcctcatccctgtcatgggtcaccataacggtcacaccgtcataatccttaagggcgtccgccagctccaggcgcagcccttccctcaggtatgtgtccatggctgaaaacggctcgtccaacagcagcgcctcaggctcataggccaggctcctggccagggccactctctgctgctgtcctcccgacagctggcccgggaatcgcttttccaacccctggagccggaaccgctccaccatctcggacaccttctgcttcctggcttccccggacatgggccggcgccttctaatccccgcgtttccccgtcccccctttaatccaaccatgatgttctgctccacggtcatgcccggaaacagggcatagttctggaacaggtagcccacacgccttacctggggcctctcattgatcttgagggcagagtcatagagaacacggccccctgccgcctctccctgggcatagcgcagggcaatcctgccctggtccgggcggataatgccggctatggattttaaggtcatgcttttgccgcagcccgacggccccagtatgcccaggcatccccgtccggtctcaaagctgatgtccaggctgaaatcctttaatttctttcttatatcaacttccaaatgaagattgtattctgagttcacggctgttcccctttcatcccttccggtttacgggccttaatgctgcccagttcatcaatatgatggacaggaatgcgatgaccacaataaccgccacatagcggtacgccgtatccatatttcccgcggccacctctgaatagaccgccatgggaagggtccttgttttgcctgctatgtttcccgcaatcatggcagtggccccaaattctcccaggccccttgcaaatgccagtacgcctccgctgacaacccccggcatgcctccggtcatgagcaccttccagaaaatgctccactcgctcatgcccagggtcctggctgccgccaccaggttctggtccacctgttcaaatgcgcccctggcagagcggtacattaaaggaaaggacatgaccacggctgcaatcactgtggctgtccatgaaaatgcgattttaacactgaaatattcaataaaaaactgtcctaccggccgtttgaccccgaacatatagagaaggaaaaaaccggccaccgtagggggaaggacaaggggcagcgtaagcacgccgtcccaaatcagcttccatgtttcatttttcatgctcaccacagcccacgccgcaaagattcccagaaaaaacgtaatgaaaatcgacaggctggctgtcttcatagatatcagtatcggtgaccagtccatggatggttcctccccttttccttactcgccttttgtgaatccgtattcttcaaataccttcatggcttcgtccgtcttaaggaattccacaaagttctttgcttcctccggatgagccgtgttctttactaccgccacaggataaatgacctttttggcaaggcttccctccggagcctctgccaccacttccaccttatccgccatgctggctgcatcggtggcgtatacaatacccgcgtcagcgctggatgcggccacctggttaagcacctctgtcacgttggttccaaagcttaccttgtcctgtatcttatcccagattcccaggctggtaagggcttcctctgcatactgtccggccggcacgctggcaggatccccgagagcaatggtctctgccttctcaatgtcctcaaacttctctatacccgcgctgctgcctgccggaacaatgagcacaatcttgttctccagcaggctggtgatggtgtcggattcaatcatgccctcctcgtccagggctgtcatctgctttgccgcggccgacataaacacatctgcctccagtccttcctcaatctgtgtctgaagcttgcctgagctgtcataggtacccttcactgtcacgcccggatactgctcctggaacatgggaatcagctcatcctcataggcgttcttaaggctggccgccgccgcaaccagaatctctgtggattcgcctgcccgggctgcggtggtctccccggcagaagtctctgcttctgtctctgctgcagtggcagttgcctgcgttgtctctgcctcggtagctgctgctgtctcctttgtgccgcctgagcatccggtcagagctgccgctgccatcactgccgccatcatcatgcaaacctgtttcttcataattaaatcctcccgaattctgaatcttatttttatatacaaatacaggtactcgttatactcacatgaccatatcgtcacccacataaatgcccatctgcagaggatgagcatttataccggacaaatacctgtattcctatatttctgttatgggtctctccgaagcatgtccgaacctgctctcaggcgcgcacctggcataggtagcgggtgctatattcactgataattacgctgcgccgtgttatcttctggcacactctgaggcgcttcccctgagtatcttaaggccatggtcaaggcttcccataatgaagccaagactctccttaaccgctttggggcttcccggcaggttcacaatcagggtcgttccccggataacagacacgcctctgctgagcatggcccggtccgtcacctccatggacttcatgcggataaattcagcgattccgggcgcattgcgctcagccacagccatggtggcctccggcgtctgatccctgagggaaaatcccgttcctccgctggtcagcaccagatccacctggcggctgtcggccagacggataagctgggtctttaactggcccggctcatccggcaggagcagaagctccaccacctcatacccggctgcctccagcatctccttggccgcaggaccactctcgtccttccgctctcccctggcgcccttgtcgctgagggtaatgacggcagccgtaaagggccgttcctctgcaggcggctccacccgcatcacatccccgggacggataattccctcacggatgactctggcaaacacgccttccttcggcatgatgcactcgcccatgcgcttgtagatagcgcagtggctgtggcattcctttcctatctgggtcatctccagctgcacatcccccgcgtacagtctggtacccacgggaaggcttctgaaatcaatgccctccaccaccaggttctcgccaaaggccccgtctatgacattggctccgcgctcgttgaacgccctcactttatcataggagagaaggcttacctgacggtgccagtggcctgcgtgggcatctccctcaataccgaaatccaccaggaaatgcccctcttctatggccctcttctcaattccccgtttatcactgatacagatggccttcaccactccggtgggacagacaccctgttttatctgctctgacatataccttatcctccaatagcaatcatgttgtgtgcttctgttatctgacccggacgctcgaagcagtgggccgcgggtttgcataatacagcctgttccatggccttcctcagttccctctgaagcccctcgtcagacgggcagccggcatagggccagcggtaatgcccctcctcctcaggccgttcctgtccttttctcagtatccgcctcaaatccactccgtcctcatagcacagacagggtttcagatacccctgggacgtaaggcgcacccggttgcagtcgctgcagaattttccgtggatcgcgctgatcagtccgatactgcccttaaatccgggtatccggtagtagacagccggtccgaagccatggacccggtcatcctcctccatatcggggtatgccctcatcatctcctccagcagctcctggtggttgatggtcttaaaattctttccgtagccaatgggcatcatctcaataaaccgcacatccaccgggtattcccttgccagctccaccatctgccgccagccatcctgtccggcttcccgctgttccttgtccatctggctgaaatcaatggataccgcattgatttttacggatacaggcatggcgcaggcccgcctgacggcttccatcacagtgcccagggcgtcggttcccgttatcctctggtacaggtccctgtccagggtgtcaaggcttatattgatgccatctatcccggcctccgccaaatcgtccagataccgctccagcagcacgccgttggtggttatggttaccttctcaatgcccggcgtgctcttaagctgcttcaccagctggcagcagtccctgcgcaccagtggttcgcccccagtcaccttgatatggcgtatgcccaggccggcagcgcagattcccacggcctgaatctcctccagagacaggatatcccatctgggcacgcactccaccccatagggcatgcagtacttacagcgcaggttgcacctgtccgtaatggatatcctcatatagtcaatggttcttcccaatgcatccttcatattgctcatcccctgttccgggcacatctggggttatggaattccccgctcttgcctccgcttttatgttccaggtaaatgtctccgatctccatggacttatccacggccttgcacatgtcgtaaactgtcagcagcgctacggacaccccggtcagcgcctccatctccaccccggtttttcccgtggtcctggccgtgcagactgcctcaatctcattgctctctttttttatggtgaaatccacggtgagcttcgtaagattcagtatatggcacagaggaatcaggtccgaggtccttttggcccccataatgcctgccactctggcaacccccagcacatctccctttgccatggttccccgggccaccttctccaggcactcagggctcataaaaatactgcctctggccactgcctcccgctttgtctcagccttatcccctacatctaccatcagggcattgccctggtcgtcaaaatgtgtaaattccatgtctgtttcctttccaacggtttcctctccaacggtttgttacatccccttgccgaacccgcagttggggaaggtacattccggacagttaaggcaaagcccgccctggcccaatgcggccagatcatctgccgtcacctggtcatccgccatgattctgggcagaaccaggtcaaatatagtacgcctggcatacatgacgcagcccggaagtcccatgatggcaaccgtacggggattttccccatctttaacctggtaataggccagcaggaacatggctcccggcagcaccggcgcgccgtaggatacgatgtctgccccggtgttgcggatggcaagcggcgtcttgtcgtccgggtccacactcatgcctcccgtacagacaaccacgtccgcgcccttttgtatcatatccaggatgctggccgtcaccttggtatcgtcatcattccatgtcacatggtcaataacctctgtgtcaaactctgaaagctttccccggatcacaggggtgaaggtatccttgatacggccgtaaaacacctcgtttcccgttgtaacgatacccacctttttatgtaaaaatggtttcagctccaggatgggacatccttctgtggcctctgcggccgccttttttgctgcctccatcttttcttcctcaatcacaagagggataatcctggtccctgccagcttgtcccccttcttcactgcaaaattgccgtgacgggtggctatcatcatctgtccgaatccgtttaccgccttaagcccccggttatccacctttaaaaggccgtcacatgctgccgtcagctcaatctttccttcctttgcctgggaacgctccatatgctgccctttgcacatgtcgcagagaatctccgccgcatcattctcatgaagcattccatcttccttctcccacacataaagctggtcctttcccacacttaagaggaccgggatgtcttccttcgtgaccacatggcccttgcggaataccgcatcctttgtcacgcccttaataatctgggtgatatcatggcacagtacggtgccttccgcatccactgtctgaatcagtttcattctatttaacctccgcccgttatttatattttcaaataacgcattacatatagaatagcaccagcgttcgattttgtaaagatacatacactacaaatggaaattaatatatgtttttatcagtttataagagaaaatggccgggtgttccatctgcgcggcacacctgaccatttccacacccctatgaggtcattcctattgagatacggaaatgtatcattttaggaccttgtttctgtatctggctgtaatcattccagtatctgagattcatgtaatcctgaggtgtatccgcgtccaggtatattcccggatcctccacctccggttctgtaatcggcactcccaggtgctccatggcccccttaagccctcctgcgcccttataggcgcagatatccggtaccagccgggaatccacccggacaggatggcccggacggccgccgcagaccgggcgcaccagagcgcccggacattccatcacctgcttaaaggtgtcctgctctatcagcgggacgtccgcaggcgtaatgagaatccggctgcacaggccggcggccctggatatccccagtttcaccgagtcaaacatctggctggaggcataattttcattgcggacaaacatgatatccagaggccacagataatccatcagctggtccgctttatatcccgccactatgatgaccggagatgcccctgctgtcttaagattttcaatggcccttacaattatggtgctgtctcccagctccagaaggggtttgaattcatgcatcctggaggacaaacctgccgccagtatcactgctccggtcctttccataatatacctcctgaatatacctcctgcttttgtcacggcggtgtttcccgggactttggctaaacctcctgtcccggcgccttcactatgaccatgacgccctttgcccgggcagccacagcgccttcccgcttaatggtgccctgggcccggatggaacgtcccgttccaaactctgtcacctgcgcctcacactcaatccgttcccccacatggaccggaaccttgtaatccagttccagatgggctgtcaccacatccaggtccgtatagtagagggcgtgtgccataaggtcatccataatggaagccatgatgcccccgtgaagcatgccttcatatcctacatacggcttttccacggtccacaaggccctggcccagccttctccctctgtaatgtccaggtgcagccctatgggattcaggcttccgcagacaaagcagttatctgattccatccttctcatacacgtttcctcatttccctaaaaatggtctcccaggcgtccccaggtctctgagaacaggccggcgtccatgagggccggtcccccctcaggtatgattggcttaaagcccatgtggtccaatatctgtgtctgtatatcaatacccggagccacctcggccagcaccatgccctgggctgtcctcttaatcacgcaccgctccgtgatgaatgtaacccggtttccctttgccaggcactgctgcgcgttaaaagaaagctgtgcgcaggattccacgaacttgtcaaaacgtccctcctggtcaatgcacatcttaccgtcttcaatgtgacatttcagccctcctgccgtaaatgaacccacaaaaatggagtgtctggcgttggccgatatattggggaagccgcccaccccggctatcttgccgttgaggaatgtggtatttacattgccgtctctgtccacctcgctgagtccgaatacagccacatccagtccgccctggtcaaagaagctgaagtggtctgtctggggatacatggccaccggattataatgggcgccaaagtctcctcccggcgcaggaattcctccgatgagaccggactctgatataagggtcacctgtgagtcaaccccctcctccatgagcacattgggaaccagtccgggcatcccgatgcccagattgcacttgtctcccccatgtatttccatggcagtgcgccttgtgaatactttcttgtcatctaacggaaggggcgctgcgctgttcttcatggggatgcggatttctccggtaaaggcaggattaaagtgggtgatatgggtctgcatcatgcgatccggatgctctgcaacacatatataatccaccagaattcccggcaccttcacattcctggggtccagggtccctgtggcggccacccgctccacctgggcaatgacaacagcacccgctgcctttgcagccatggccaggtccagcggctcgcagggcatgcattccttctcgtacgtcagatttccgtcctcatccgcggtggtggcccgcaaaagggctactgtcagcttgggcagtgtataaaacagatactcttctccaaggaagtcgggaatgtatgtgacaatctgtttcccttccttttttgtcttttcattgatcatggccccgtcgtatctcgggtccataaacgtgcccagtcccacctttgtcagaagacccggaaagccccgtcccatctcccgccaaatctgccccaccactcccaggggaatgttgtatgccagaatcttgttgtccacgatttgttttgtcaccttaaaggaacatcccacatggccgtgtatgctgcatgaaagcagtccgtcgtgagccagggcacactcccccctgcagatttttccgtcctcagacatccggccgaaatccccctggcccgcgccgtggatatgggtaatgcccgatgggtgtcctgtttccataaatctgttctcaattgcaagcccgatttcctcaggccagcctgtcattccctggactgccgaaccgatgaccgctccgtcctgcaccagctctgccgcctctttcactgttatgatttttgccatgtatccctaccgtcctttcctgtctctccggccctctgaccagagacagccgtctccctatctgaccgccgcagtcctcctgattccgtttccgcctgccgcagttctcccgttcccgtttccgtctgccgcagtccttccgtttccgtctgccgcagtcctccctctcccgtttccggctccgtctgccgcgtcccccttccttccagatgctccctggcaaggcttcgcagctggcccttggatatcttcccggtagctgatatggggaaatggtctgtcagctctatctcctggggaatcttgatggtggcgatttttccccggcaccagttcctcaggccttcttttgtaaccaccgcgccttcctttgggcggatgaaggcatataccagctcgccgtactgttcatccggcgcgcccaccacggccacatcctccaccggctcataattgcgtataaaatcttctatttccctggggcttatattctccccgccccgtatgattaaatccttgcatcttcccttcagggtcagaagcccgtcctctgacagagaggcaatatccccggtgtgtagccagccctcccggtccactgccttttccgtctcctccggattgttgtaataccccttcatcactccgtagcttttgatgcacagttcaccggcccggcccggtcccagcacccggcctgtagttaaatcctgtatccggcccgtaacccccggccacagccttcccacggtggagaccgctgtttccaggctgtcgtccatggaggtgctgctgattcccggtcccgcctctgtcattccgtacatgacaactgccgcctctgcccccataacccgtttcatgtcccttagggtatgttccggacagggcgctccggccgtgacgcacaggcgcaggcataaatcctccctgccggcctttccttccctcatctcccggataaggcggatatagacagtaggtacgctgcacagcaccgtgcaccgctccttcctcagcatttccaaaaggcagattctgtccgttttctcgtaacagaccagggctgctccggccatcatggaactcagcacggatcccacacagccaaaggagtggaacatgggcggcgtcatacacagccggtcctccttctccagccccaggtactgtacatgaatccaagcattttccagaatctggtagtgattcagcatcacaccctttggcacaccgctggtaccggaggtatggataatggtggcgtcgtcaaaaggacggaccgccttcatcctctccttcagcagactgtcacccattgacattcccagttccatcagcttctcaaactgccaggcgcagcttctgggccgttcctggtccgtgacaatcacatggcgcagcaaaggcagacggggcgcataaatccttccgggaacagcctccttaagttccgggctgatctggtaaaacatgtccatgtgctccctgttcttgattccctgcttaaggatgaccgccttcacatccgccctgtggagcaggcactccagcatatccttcttttcgtggatgttcaggttcactatcactgccccggtcttctcgatagctattttagtcaccacattttcccagcaattatccatgataaccgccacatggtccccttttaagatacctatgtgcatcagcccttttgccagaccgtcgctgcgcctcttaacctccctgtatgtaaggcgcacacctgccagactgtcaaccacagcctccctgtcgggaaagcgccgtgcctgtatatccgccagctcacccagggtcagatggatgtaccggttgagacagacatggtaaggcctgccctcccacatggcctccacgtactcccggccggataccaggggtttgttcctgcatatccctgaaagcatatccgcgaaggcctctgaacagggcacagcgcccctgaaatccagcaggcagccgttcctgtcaaagagaaaggaggcttccccgggactgttctcatccctgcaaaccactgcttctattcttctctttccgtcaatcaggtcttccatccaaccttcccctatctctgagcccgttttttcatagctgtcagaacaaacaatataatcaatgccaccacgcccatggcacccactgccatcagcggcacgctgtatgaccctgtgttgtcgtagagactgttggccagaatcggccctatgtaaccgccaagggcaaatccgataaacataatgccgtaattaaccccgttatatttgattccaaaggcatctgccgtcagagccggataaacacccatgcttccgccgtaacacatggcgatcagcatggcaaataccaggaacagggccagtgagccgctttccgtaaacgcggacagggcaaagccgcttaccgctacaatcaccgccatgatgcccagagccggataccgccccactttatcggaaacccatccccagaacaccctgcctcccgtattggccagaccaatgatactgaccgcggttgccgccactgccgcgtccaccccgcctatggcctgggccatgggagatccctggctcaccaccataaggccgcctgtggcaaatatggtaaatgcaatgatcatcagataaaatcttgtgtcggccagcatcagcttccagttctttccttctgcagaagcacccgaactgttcttcactgccggaggcgtccagccagtgggcatccatccctcaggaggttcggttatgaaacaggcagctatgattatcataacaccaaacaggattcccagcacccggaaggtaaacatgacgccgccggaaccaatcagggactgcataataggcgggaaaataatgctgcctgccccgtaggcagccgtggatatgcctgcaatcaatccccgcttgtccgggaaaaaccgcaccgtattgccgatggtaatgccataggcaaaggcaattccaaaaccgcagagaagtccgtatgtcacatagagcatggtcaggctgtggataaagctggtgcatatgagtcccgcgctgaacaagattcctcccagccacaccacatttctgggccccttaagcttcttttgaagtccgttgcccgcaatcatgggaatgggcgccacaccgctgcagattgtaaatgccagggccagctgcgacttctgcacctctgttccgaatatcactgccccctcgttgaaaagtcctgtctggtaaacactccatgcaaaccccgtaccgatacatatattaacaataacactggcaaccagtaccgcccacctttttttcatcagatccataaataaccttcttccttgtccgcctaaagacctgctgttaattgttatttttttaacattaatttgaaaaatatagttacggttccacctccgccggagcacatctgacacccgctccgggaaggtgaaaccataaactcccagtcatccatgtacttttatgcctggaccgcccccatatccagaatcatcttctttataagagcccttacctcctgtatcttatatgaattattggccatggccgcggtcccctccactgccagttcagcagcggcctctgccagcgcctcatccggcttcctgccggctaagaacgcctccacctttttccgctccatgggcaccggggccacgccgcccagaacgatccgcgcatcctctatgaggccgtccttcatcctgtatgcgtaagccaggctgacaatggcaaaatccactgcctcacggaccctgaatttgtcataggccgtggtatatccttccggtaccctgaaccggacagccgtcaccagctcgtctgtatccagcatgtcagctgctttcaggcgggtggtaaagaagtccgccgcccttacggttttctttgtggtcacaatccgggcgtctaacaggatgagcaccggtgaaatgtccgaggcgttgacggagtagcagccgcagttcatgcaccgtccggcctccctggccgcttcctccccggtcagggtgaagctgtcctccttatccagggcccgctctgcggcagacagctctttgtcctttaccgcgtgctcctccttgacgcctgcggtgtcaaaatggataaacttatcttccctgcgccgctcaggcatgactgcatagcccctgttaatggcctccgccgcgttgcgcccggagcgcacgccctggatcacggtggccggtcctgtggtggcgtcgcctccggcataaatcccggacttgctggtggcctgtgtgtccttgtccacctgaatcagtccccgttccagggcaaggccgtatttgtcgcccaggaaacttaaatccaccttctgccccgctgccatcagaatggagtccgccgataccctgagagtctcctcccggtcgtaccggggattgaaacgcccgttctcatccttgacggaggtacagcgcataagctccattcccgtgacctggctgccctcatagattgcctttgatacgccgtaggacggcatgatttcaatgccctcctccctggcccttgcaatctcttccctgctggccggcatctccggctcggactccaggcaggccagggtgacgctctctgcgcccaggcgcctggcggttatggccacgtccattgccacatttccgcctcccaccaccagtacatggcggcggtcctttttgttcatccactggttgacttccatcaggaactggaggccgaactccgtgaactcctcgccgtcaaatcccagcacaggacgtttccaggcgccggtggcatagaacacattgtcatactccttctccagatcctctgcctgtatatcctctcccagacagcagcccaggcggaagcggattcccattttttcataggcggcagccacctgcttcacataggacttgggcagcctgtagttgggaatggcataggtcagcatgccgcccggctcctccatcttgtcaaagaccgtcacatcatggcccaccttcctcagataataggcagcgcttaggccggccggaccggctcccactaaagccaccttatggcctgtctctgtttccggcgccctgtaaaatgtgtccgggtgctccagtatgtaatcccccacataccgctccacgccgtggatggacacgctctcatcggaaccgcagcggttgcactgctcctggcatgtatgtgcgcagaccctggatgtaatcatgggaatggggttggcttccataaggatatgggccgctccctccacatcacctttccgaagccgctccatataagccggtatgtccgtattggccggacactggacagaacacggtgtggtatgtaccttcatgcccccgaatatggaatgataacggttgtctcccataacggcatagcactcttttccgccctttctcatacagtccatcctgccgccgatgccgtggggatagcggtaaaaccagcagcgcacatcctggcatatgttgcctcccatggtggccacattgcggattaacggtgttgccacggagcgggccgcctgagagagaaccggagccttttcattgagcaggtccgactttacgatgtcgcagagttttgtcagggcgcctatttctatggtgtccccgtcctgctttatgtattccccgccccggacggtcttaaggtcaaccactttttccggataatcctccagaatctgttcctttaacactccaatcaggtcggagccccctgccattacgactgttttcccttttggggactcttttaataaggagactgcctcatcaaaggtggcagcgctctcatgctcgaaatatttcacagtgaatcctcccctcttatgctttgcctaacgccttaagtataactgccggagttgccgggtaatccttgatgtccacgccgattgcgttggaaatggccatcagcaccgcgctggctcctgccgcaccggaaatctcgccaattcccagggccttaaacatgaaggaatctatctgggattccatgatataggcgtcatatggcgggaattcattgaacgttctccacttataatctatcaggctggaggttaaaagccttcctgtggacggatccaggatacactcctcaaatatggctgtatcaatacaggctgatccaaatcctccgtgcagctgcatctccactgccttggaatcaataatctgtccgatgtccgtgcctccggccaccttcaccagcttggtattgccggtttccaggtccacctccgcctccacgaatatggccatacagctggggatattaaacatctccatgtgctttccatatcccacaatgctcagttccttgggggccagcttgaacatgggcactaccagctgcgggttatcccgcacatagaccataaagtcctttgtgtccagctggtcaacggaacgcttaaagtaaagggcgcccagctccagggcttttttctttgcctccatggctgccagggatactgccttgcctgtggtaatggtgcctctggaaccgcagagaccgtagttggacggattgaacttggagcccggctccgtgatggataccttctccaccggcacattgaggacctcggccacaatcttgcacgcgttgcttctggtacccatgccggattccgtgatgtcacactcaatgatggctgtggacgccctgcggctgcccaccaagtccggaacaatccttacaatggcctctgtgttgtcctcgctgatatcagcatttccgatgacgcccatacccacgccccttgccttggttccgtttacacatgtgggcacgttccagcccttccatttaccggcccatccaaagcggtccgccgcgttctgcatggcttccgggaagaacagggaggagcggctctgccaccaccgcccgtcgcgccagataaaccggtcgccgggagcaatataatttttcttaaacacgtccagaggatcaaaattgcccttcttcatcacggcgcacatcaggcgctccagacagctgttaagctcctgcccgccgtagccgcgtacaatgcctgccgcctgtttgttggtcactgcgatgtggctgtccatataccagttgggacatttggcgcataccagctgcgcctctcccagtcccacgcccacctggccctgtatggagtccgcaatggctcccgtgtccaccagccagtcgccttccacagcctttacataaccttccttgtccattcccacctttgcggtgatggtgctgcccagacgtacctcgtaggccataagctgctctgcctttgtgagcacaatctttaccggctgcttggtgacaagggacagcatggcggcggagagcaccgttgtcataagggactgcttgttgccgtagcttcctcccacgttaaaggtctttacgctcaggttggaattgggaatccttccctcgcccataagcttaagaatatgggagctctgggacgatgcccatatggtatactcattgccgccctcatatttggcgatgcaggacggggtttccggggccaggggcgaaggcattttgtcaaaggccaccttgtcttccgccacataggctgcttcctcaaatcccttctccacatccccgcggataatctgccaccagggaccgtccggctggaaatacttgattccgttgtcaacgtgattgcccttaaacctggaatatatctccactgccccttccttcagggcgtcctcagccgtatacacggcttccagctgttcatattccacatcaatcaggtctatggcctcctctgcagtctccactgtatcggctgcaatcagagccaccagatcccctacatagtaaaccttgtcttccatcaaaagcctgtgtacaggaaggcccagtccccactgctccggcatgttcttgtgggtgatgacagcccgtacgcccggcagggcttctgccctggatgtgtctatggaaaggattctggcatgaggataagggcttcttttggtctttccgtacagcatgtggggtactgaaaaatcgtccaggaaaattgcctttcctgtcacaatgtcctttgcgtcttttctgggtgtgtacttgcccacatgacggtaattgggctgtttgatatcgcggtattcaagcttgctcattcttcaaaccctccttctaatccaatgaatggtcgctgtttgtaccatttgcatagggacttaagaacagttcctggcgtaccgggatgggattttccacatcatcattagcccggtgcatcacagccagatggtcctcctcattccccgccaccctgttaatggcccgcagcaccgtataatggctgatgcagcggcagtaattgcccgacatggcttccttaatctcatctcccgtgggatggggattttccagcagaagcgccttggccgccatgatgattcccggggtacagtaaccgcactgaaacgcatactcgtcaataaaagcctgctgaaggggatctaaccccttctcagggtcctccagcccttctatggtaacaatgtcttttccatcgcaatccacggtcagcagcatacaggacgtgaccccttttccgtccatgagcacggtgcagcacccgcaggctccttcactgcatgactccttggagcctgtgagctggagcctctttcgcagggtctgggatagtgtctctgaggggggaacctgtccgaatccgtccccgattgagaaacgatattccctcccgtttaccgtcagagtaacatattgtttcttcataacgtttccttgcctccttatctggattaagttaatgggatatatttgttaagattatgctaatctaggtcggtcgtttgatttatttttatcacaatgtaatacatttgtcaatgatatataaatatcaatttatttattcgtgtatttttacagtttcagacaacaaataacccttcggatttatgcaacttgcactccaaagggttattctcatttgtgtatatcgtctaaatacgattacagggccggatgaggcggaaacagctcaggcttcatcagccgttggacaatagccagacaatttccctttatctcctcccgtatccagaggggcacagactccccctccagcggttttggaatcagatcctctatgaatccccggtgttccccaaaggatatgatggagccattgatatgtctgctggctataatggcctgggactgggaaacaggggccacggtctgaatcagctcagccatcacccgttcctgccggtcaaaggcagcggctgacaaaggcctcatatccccggggccattgttctcccagtatatcagggcaagggtagtcttatactggggggcaaaggccacctcaatctgaagatctataagcttttcaaggaattcatatgccttctgcggagtcattgcatcctgtttaaaggtcccctcaatctccatatacgaggccgcataatatccctttaccttttccagcatatattccaggcaggctacgtacagcctctccttgttggaataatgaaaggcaatggctgacaggttcacctctgcctccgaagcaatcattctggtggatgtggctgcatatccgtactgcgagaaaagcttaatgccggcttttatcagctttgtcttagttgaattatttccttccatgtgacttcatctccttatgctcagccggcagcccattcccgtatccgcgccttcctgtccacagatgcctggggactggttccgaaggcatctgccgcctccaggcttcccagggccgattccagacaatgcctgactgcctgagcctgattatattgaagtctatggttctccctggcctggggggtggtacacttgggcgcgctctgacggaaacgctcatcaatatccaccattctgtcctcaagcgtcatcttatccgccagaaacaaaagggttctctccgtcagtcctgactcttccccgccttccagcctgtgatggcactgaatgattcctgccatcaccgggtatccctccatccgcaggattctggcccctgcccttgcgtggtccggcttcagacgcgcgatatcgtgaagcagcccggctgtcctcaaaagctcaggatctatgtcataccccagacgtttaagccttacagcccactggtgtgccagccttgccactgctgcctcatgaagccgtatatgctcagggacactatagcggtccgacagcctgcggcagatgccatggtcaggatagagaaggggctttacaccggtctgctcatagaatcctctgaacacgccgtcatcgtctgccagaatccggctgattcctccatacggctggggaacttccagtacgcggttgatatcccaaccaagaataccgcacatcagcccccggctcacgccgcagtgggtcaccaccgccacatccccccgggtattcccaagaatgcggttcagggcatcctgaagccgctctgcgccccgggcaaaggattcccctcccggaggcgggaccgtgccgatggaacgtcccctctcttcatagagctgcggataccggctgcggatttcagtgaattccatgttctcccattcacctgcatccagctccaccagaccctcttccacatgcaccctctgctgctctcctgcaatatactccgcggtttccatacacctggacagaggactggaataaacagcttccacacagcggctcttaaaccaggaagccagttccatgctctccttcctccctctgatactcagtgcgagattcgtatgtccaagacatctgctcacatgcccggtccgttccggttccccgtgccttataaggtatatcgtcctcatatgccacctcatttcgatgcatcgccgatactaaataggtcgtccgacctagttctgtgtttccagtgtagcacagatgcatttaaattacaatataaggcagccagaaaggccatattcttcaattatcgttatttaatctcataaacaacgttgacttgagtatatcacatatggcggatggctgtaaatataaagcgcctcaatgcatcttacattttctttgacttgtttcctgcctgcagacccacctgagcagttccctgtactcttccctggtgtccacatccaggtaaatactctcatttccagcctccaggtcctctacaggcacgcctgaggcttcaatggcccccttaagtccctggtccccggtataggtgcagatgcgtctggcaatctccccttccatgcatatgggatgccccggttcgccgtcatggaccgtccgcacaatctgccctggagcttccattacctgcttaatgatatcatccgttatggcgggaagatccatgggcatgaccaggatccgctcacacccttccagtgccgcctgtatacccagctttacggaatcaaacatctgtgtatggcggtatctggtgtttctgacaaaacaggcgcctgtgccctttaaatgatcttccagttcttccgccctataaccggtaaccacgatcaccgggtctgcccccagccgcctgagcatggacgtgacgtgaaatgctatggtggtgtcctcaaacggcagcagaggtttaaaatcccccatgcgcgaggacagtcctgccgctgccaggacagctcctgttttcttcatgcttcccgcccctttcctgtaaaagaccgtcttaaaaggctgccttacaggtattatatccggccggagtgcgggattccagtagtgcaggatacaccctatacatgtgcaacaaagaaaaacacggaagcagattttactccggttccgtgtttttctttcattattcctactggcacatcctctcctggtgccgtttcagtttctccaggctgcggatgcagtaatatccgttaatctgttctatcagcgccatctcctttaaatccttgatggccctgaccgccgttacccggttaattcccagcagatttgacaggagctgctggcttatcttttctttgataagtattttcccgtcatagggaaccccgtagtgctctgcaaatataagcagcagatcgcaaatcttccagccggcgttgtggaaattggtatggcgcacctgctccatggctgacaggaatttggtggatagggactccataatatccatggagagctgcgggtcatgggcaatgccctttaacagcatctccttggtgatacacactaattcagacggctgaacggtcttgaaattcacagctgattcctggtcaaagagaaggtttccttccaacaaaacagaattgctctcattgaaattataaatacgctcctcgcccgtaaccgttgtctcaaacgcagccacacgcccggtcttgactatgtagcagtagttgggctttgtacctgcctgcaccagcatatggttctttggaaatacctttctctgtcccagcttttccagacgcgatattcccctgggcagatatagaagacgtgatacaaaattagcatgcggcatctgtactgcggtattacactcctgacctaccatataaccaccctctcttttatggattttcaccatatgaatccccaaaaacgccagtttccttcaacaaaattataacactgttagtattttaacaactagtagcctatgctacattatatcaaattttcacatgtgatgtaagtgtcatatatattgcagcagtaactttccacagataatcatttcgtgatacaatgaatcacgtaattaaatcataggaggattggaattatatggaaactgtcatcatactgggagcaggccagtttggccgcggagctgccagactgctgaatcaggaaaacatggctcttctggcgtttggggataataaccctgccctgcaccagctgaccgaatcagagcggacagagaaaggatttccagccaatgtcccggttttgccggtagaaaaagccctttcactgaaacctgattatatcattaccggagtgacggaccccctgcgttccggccagcttaaggaacaggccctggaattgggatacgaaggcagatttctgatgctgagccagctttaccggtattttgacatacgaaacgccaccctgaaacggctggctgagcggattcatggacagggcctgctggaaaacatagcagaactgggcgtttttaagggcgacacggcctggaagctcaacgccctgtttccgcagcaaaggctttatttattcgatacatttcagggatttgacccacgggatataaaagaagaaaaaagtaagggttgttccatggccagggaaggtgaattctctgacaccagcgagcaggccgtgctggggcggctcccctttccggaacaggccgtcatacgcaggggatattttccggatacagcggcaggactggaacaggagcgcttttgtctggtaagcctggatgccgacctgtacgcccccattctgtccggtcttatatttttctacccccgccttgtccccggaggcatgattctgctccacgattacaacaatgagcggttccgcggagccagacaggctgtggaggaatttgaaaaacaatacggccgcctgtgtctcgttcccttatgcgaccttcatggtagcgcggtgattgtaaagccttgtgattagcagacaacaattgtaatctgacatcacatgtgacctgggctacttgtgtctgttaaatttatgacctacaatatctgcagacagtatgatagggtgataagggggagaatccatgaagacagttgttattctgagcaccgacaatcttggtatgactgtggcagatatgctgaatccgcgtgaaatgaaactggtcggtatgggagataccaggcaggaaacctggaatgtattttcagacctggaaaaaggggaactgaaggaagaaatagagggaatgccaatcatgccggcagatctggcagtggcccttcagccggatgtcctggtcatcgcggccacggattccgaaaaaagccatgccctggaatacatggccatccgcgcaggattcctgaacgacattgttttcatccgggacctgcatgagcagttctccatccgatgcagcgtgctgcggcgtctgtgccggcggctcaccggtctgggggtggagggaaatgtggcagagctgggctgttaccggggcgacacctcctggcagctcaacgtgctgatgccggaccggaagctgtatctctttgacacctttgagggattcgatgaacgggatgttgacatggaacgaaagctgggatgctccgacgctcagacgggcctgtattccggcacagacaaggaaaagctgatggagcggatgcccctgcccggacaggttgttatccggaagggctggtttcccgaaaccgcctttgacattgaagatgaaacattttgtctggtctgcatggacgcctgcctgtaccagcccaccctggccggtctggaatttttctttccccgcatgggaagaggaggcgtcatcctcttaagcggatgcagcgacacccggtacagaggcgttgcaaaagcagtggaggacctggaatccagatacggcgcccttcttatgcttccggtgggagacttagacggcacagtgatgattgtacatccgtaggatgggaaatcatagaataaaaaatggattccggacctatggaatccggaaacggcagcagccgcaggcaaaaaagcccaatcccttacgttcttcctatggcgtgccttacaattgctttacacggcacgctccggctttcacctggcggttttgaggatggaaaagagcgcataactgcccgccgccaaaaacgcatgcatctgtattggggaatacgcaggcagcgtacagataaggagggatggaaaaggtaaatttttcggggctgtaatcaagcagccggtacaacgctgtcggcctgtgcagacggacaccggttatccaaccctggttgtagagaaattgaatggcgaatctcccaggatacgccatgctttgtattaaagaccagaaagggcgtattttatgaacttttacaaaaatcattttggtatgattatatcttctgttgtggctatctgtatctccctgattatggccacatcggcaatctttgttgacaaactcacgttcacgctgcccctgctcatcaagaactggggcacggctttcctggtgatttcattgaccggaatggcctttcctctgacggactggtcatttgccctcggcaggaaaatggggctcaggcccgaaaccctgccccatgtacttgtggaaaactttgtggccaccctgttttttaacaccacggccaccattgtcctaacagcagtcaatgtctttcacaacccggaaattgaggctgccgtggcagccggttttctgccaaatactctgaccgcatttgtgcagggcgtgcttcacgactggcccatcatgtttatcatcagctatgtattcgcatttttcgtgacaaaggcagccatcaggattgcaaagcaggctgtgggtgaacttaaatcccctcattcaccccagaatcagtttcaataaggaataacagccaaaaaggacatcccgcatcgtgactggtccatgcgcggatgccctttttcctttcatttttcctctgcgttccttctaccgttccttctaccgttccctctgccactccccttttgcattcctgccaaaggcactgccctccttagcctctgcatagccaaggatggtggcatccaggttgcatatatcatttagggaccagatggtaaagttgtccggattcctgctgtattcatcgctctcatccccggcaaaaaacctccatcccgtatccgcccactgttcgctgggccggctgtccctgtacatatatccgatggcccttccctccacaatctgctttgaaacaatgcagcctccattatggggcagaagactgacccattcccgcttttccggcgcgtaccaggcatttctgtaccaggctcctccctcctccagcaggtgtaaggccagctttctattcaggtccaggaaggaaagcatgtcttcctcatcaccgcccggcacatcatagacagccccgcagatacagctgacggcatagtccttaaaggtgtggtaaaatacctgggccttgcggacctgatagtcggtcagctcatcaaatgtctccctgtctatgatgccgcaggcacaggccaggcgtcccagtccgattctctcattgatgtcccatgcatagaacccccgctcccccacatagggacggaacagggaggcccgcttaaaccgggtctcaaatgcccgtctgccctcctcctccagctcctccaggtcaaacagcggcgcatcgcaccagaaggtcataaactgctcatactccctgcccgaggtaaactgctccatacagaccttttcaaggctttccctgtcatagataccatagagccggaacagatgggccttcagctcctctgtcgccggttcatccccacaccggtaaagggtccggtaccccatgtgggacggtattcccggcgccctgcggcatgcggcaatcccgtttagcagcagggtaaatgcatgtctgtccgtctctgccgggtccggcgcttccggcattctctgtatctcctcaaccagctcctttacagcctgtgatactctgtccattctttttcctcctggtccttactgcatgtttgaaactatctgctaccagcatattacaactgtaatttaaatgcaaccttgattcacattcattttaatcctgcggccaaacaaatacgggcctcctgttcccggaagcccgcatcatccaaatcttatctctattcccattcaatcagacaccctgccccatggcagccctgccttcatacctgcattccccggatatgtcctggtaatggcaggtgctgcaatccgtgacataacccacatacttctcagtctcaatataagccccgcacatgccctgatggcgggcgtatacctgaaggcacatatcagccacgaaattacaggcagtggctttgcccccgcaatacttacagacataatcgccgcaggccctttcctccgctaccacgccgtttggcaggcgcattttctttaattgacggcccataatggcagcctcctttccattttgaaagaaggcggcatgaagccgccttcctggtttcatctgatcaaccgctgaactgcctttattttgaattcctgtcatccttcatgccgtgcagcgctctccagatatgctccgggtccagaggcagctctgtgaagtacacgccggttgccatgttgaccgcattggcaatggcaggcgccacaggtgctgcggagccctcgcctgcttcctttgcgcccagaggtccttcctcgtccggtgtaaagtcgtagaaggtgcgcatcttcggcatatcaagggcagtgggcagccggtaatcgcggaagttgggattgagaatctttccttccctggttacattgtgctcataaacagcatagcccaggcccatgccgatggatccctccagctggccttctacggccctcttattcagtgcgcggccgcagtcatgggcaaatacaaattcatcaatatccaggacgccggtctcctcgtccacagtcagatgggctgctccggtggagaagctgtatgcaggcgcatagttggtggtattgttgccgttatactgtgaattgtcggtacggtggtaataggatcccacgccaatcagttcatcgccgcccttgaccgtcatatatttgaacatggcgtctccaatggtcatctgatactctgccttctccttgctgattacctttccgtccagacactctaatgtctccggcatcacaccccacataggtgcaatgacctcaaacagctggcgttttgcatccacggcagcgcggcgggccgcattgccggccaggaaagtaacacggctgccgtaagagccggaatcccagggcgtcaggaaggtgtcggacataaaggtcttgaccatatccatgggaagccccagttcctcggccacaatggccgtcataaccgtatcggagccctggcctatgtcgtgggagccgatgtacagggtggccatgccccgcttgttcatgcgcagggtcacgcacgcagagctctggttgggcgcttccagcaccgcgaatccggtgcccgatacaaagccggtgcccgcaaaaccaatgccctctccctttttcagcttatccttcttctcataccagccaatttcctttgcagccgtatccagtgtctccttgtatgcgcagctggtgattgccagtccggccggagccacgtatccggggtctgccgcgcttatcttgcggaactcaaccgggtcaatgcccatctggtcagccgcgaactgcatgttcaggtcatgggcaaaatgcacctggcatgctgtatatcctctcatggctcctgcagaagggttattggtatacacacgccttgccaggaaatccacggaattcatcttgtaagggaagttggcccacaatgtagactgggcgcaggccgcaacaccggacccgccgtaaggtcctccgtccagcacatggtagcatttctttgccagcagcttaccgtctgtcccaaaggcagtgtcaatatgcatgtaaatggggtggcggttgcgcgtggtctggaatacttcttcgcgggacagaatcatgcgtaccgggcgtccggtcatctccgccatcttggcagcgcaaagaccaaaggaataggaatccagcttgccgccgaaaccgccgcccacaagaggcttgattacccgcacctggttctctccaacgccaaggcagcgggcataccagaactggtccacaaaggacatctgggtggacatccagatggtgtaggtcccattcctgtaggtagccactgcgccgtggggctccatggccgcatgtaccatacggtgggtcttgtaatccctgtgctgcacataggatgcgcggtcaaattcctcatcaatatccgtgcccgccttcatcacggactgcatgccgatattgtgtatgcctttgccctcccagtttacctcgggggcattctcctccattgcctcaaaggggtcaaacacccccggaagcacctggtactctaccttaatcagatccgcggcccgctgggcggtttcctcatccacagctgccacggctgccacgtcgtcaccaacctgacgcaccttctcagaacacaatacttccttgtccgcgaactcagctgcgaattctccatttcccaccagggacttccactcaaagtccctggcagtgaggatgcactttacacctggcagcttctctgcctcgctggtgtcaatggacaggatttttgcagatgcataagggcttctgaccatttttccggtaagcatatccgggaacatgatgtcacccacatactggccgtgtcctgttaccttgtcttcagcgtcaatcctgacataattgttctcgccggtcagacggtaaaattccggttttttaaaataatgtttgtcacagtctttatgcattctttgcttcctcctcccagttcatctgcgcagcggctgcctggattgcctccacaatctttgcataaccggtgcagcggcacagattgccctcaatggcttcccggatttccagttccgtaggatgtttattcacatccagaagagctttggcggacataatcatacccggagtacagtagccgcactgcatggcccacttctctataaactgcttctgaatgggatgaagcatcccctccctggcaattccctccacggttatgatctcatggccgtcgcactccacggccagggtacagcaggagttaaccggcttaccgtcaagcatcacggtacaggcgccacactccccttcctcacacccctttttcgtgcctgtcagaaacaactggtcacgaagaaaatccagaagcgtcaggttatccttcacaatagcatcaaccggatctccgttgatgattaaacttatactatgtttcattcctgtctccctcctagttatgagcattccatggcctgcttaatggcacgttttgtaaacacgcggatcatatccttcctgtattcggccgatgcgcggatatcagagattggatgacaggaattcattgcttcctccgatgccttcacaatcacctcatcggtaagttctttgccaatcagggcttcctccgccctgggcgcccgtaccggcgtggccgcaaccgcgcccagggcaatcctggcgtctgtgcagacgccgtcttccaccttaatcttgactgcgacgccgatgatggccaggtccatcgcctttctgaccgcgtgttttatgtatgcagccctctcattctcagccagcggcggaatcacgatgcctgtcacgatttctcccggctccagggaagtctttttgacacccaggaaaaagtcttccatttgaatgacccgatccttgttgggaccctgtaccaatatcttcgctccctgagccagtaggttgggggctgtatcgcaggatggggacgcattgcagatattgcctgccatggtgccctttgtcctgatttgtgtggatgccactaccttggcggcatgagccactgccggattcttttctttaaccagaggcgatgtctctatggtacgcagtgttgtcagcgcccctatttttaaaccttccctgtcatcgtattccagataatccaaacctggaattttcttaaggtcaatgatatactctggtgatataaccttgtctttcattggcggaatcagatccgttgcgcctgccataaccctggctgtgcttccaagctcaaggagcagattgcacgcctccccgatggtcttaggagcaagatactcgaattgaggtaataccatttacgttttcctccttacacttctttttattgcctgctaattgttacgttctccctgtatcataattgtagaaggaaacgcttccgcttgccagaagtgtatatcacagatgttgcaattgttacaccttttgtctctgtttcacgcgtacatcctgtgggaatgggaaatgcaaaaaaacagctgcaataaacgaatggccaggctgccggtatctcctgcggataccggcagcctggccatagcggatatggaaaccatctgcttgaaatgacagcgaaacgcgcagaatactatactccattattctgcgaagtaattctcaccttcctgattttccccttgatggtcctgtcctgaaggcctgccagaacctgagggcctttgcggttcaatatctccacaaaggtgaggctttccctgatatctatgattcctatgtcctccgcatccacgccctctatgctgcacacagcgcccacgatatcgccggacctcatcttggatttacggccgcccccgatggacagtctggtaatggaccggtccagcttctcccccttatgggggccgggatccggcttttttctctggagggcccagaaagccttttcctcctcttcctctgtctccggacagggaagaaccggcagcggcactcccacatacgcctccgccttgtgaagcgtccttatctcatcctcagtcacaaggctggccgctctgcctgcctttccatttctcccggtccgtccaatccggtgcacataagtctcccttcccatgggaaaatcgtagttcaccaccaggcccacgtcctcaaaatcaattccccttgcggccacatccgtggcaatcaggtaccggaaccctccccgcctgaatgcgtccacatttttaagccgttccttctgctccatatcaccgtggatcatgccgcagaatatcctgtctcttctcagcttctggaataatacctggaccatttccctggtaccgcagaatatcatggcgcgctccgggttttccttcatgagaacgcgcttgaatgccgtatacttctggtcctgtgcgacgccgtacactgactgccggatgggaaggggcgtctccccctcctgttccaggaaaacggaaaccgcatcctttaccgtttcctctgccagcttcttcacatcctcatccagggtggctgaaaaaagaagggtctgccgtttctcaggaaggagccccacaatctgcctgacctcgtccatgaaccccatatcaagcatcagatccgcctcgtcaatcaccaggtatctcaccccggtcagcttcaggctccccctgcgcacatggtccatgacacgccccggtgtccccaccacaatatgggttttctggcgcagtgtctgtatctgcttgtcaatgggaaagccgccgaacacagccggtaccttcagccgttttttcctgccaatcctgaatatctcctggctgacctgcacggccaactccctgcttggctccagcaccagagcctggggcaggttttcctcccagactatctgttcgcagacaggaatggcaaaggcagccgtcttgcctgttcctgtctgggaccgcaccaccacattcctgcctgccagtacatgaggcagcacctcctcctgcactctggtgggatgctcataccctaacagcgtcagcgtctccgtgatttcaccggataaaccgtagccgtcaaaacagctgtccggttctgttttctgattattttccatatatctccatttctttacaagggagcttctacctgtgcccgccttctatatcttctttcacaaacatgatcaggaagctgaccagcaaaagcccgcagctgacccatatggtgcgctccctgagataggctgtaagtacactgcccatgacggcacccactgcaaatatgccgatgactccatagtagcggatacatttatcccgatggtcctttttgcccgtatggcggtaccagtacaggttttccgtggcgctgcgcagatttccgatacacatggtggtggcataggggcttcccttgattttcctgaaggcattgacctgaagggcgcatacaaatgagacaatgatattggctgccatattcatatcctggggcaggaatcccaccacaaaaagcaaaatgatctcaatagccacaatcagctgcctccaatggaaccttctgtcctgccggtgaagccgttttacatgctccgccatatacacgccgccggcaaaggccagaacaggagccagataccgcacagccaggttccactccctggcggccaaatggcttcccataagaacgatattgcctgtctgtgcattggcaaacacatttcccctgcagtaatacgtataagcatcctggaaacctccggataaagtcaaaaaaatacccgttgacacagcctccgacatctgtccacgggtacccatactcttttccatctctcctgccgcctttcccaagttaagaatctgattcttccaactcaagattttaccacagttcagactaaattaaaatagttaaatgtttcacagtttcattacgcttcgccaatctggctggtaatatagtccggtatctcctccgggcagatatccagggcagtggccagttcaccaaacagcagcttccgggcgctctttacgccatcccgctcacggatggacaagggctttccctttcccctgcggttctgctccatctctgatatctccttaatcatagatgccagttcagtacaatcgccggactcaaggatctgcctgtatgcctggggtctttccttgtcgtttgcatactgctttccctcaacagacggcagggccagtatgaactgctctgcttcctgcctggtcatgatttccctcatctttacctttgggctgtccaccggtatatagatggtggtatcctggtcaaacttcggcacaaggctgtaatacaccttgtcattattagagaagtcaggtttcgatatgccttccacctggcatacgcctacagttccatagagaatatattctccttttttaaacaaattcccacctttccgaacagatactgttcaagtgttaacggggtatctatatagtatatcacacttttccctatttgtaaaatgccgtcagccgacaaaggtatcctgcacgtaagccggcacaggttccggcactccggccggcggcatttcttcggtgggttttcagaatcatttcaaagtcctgctgccgaaacaacgaaaaatatgcccgggaaacatgataaactttctcatgtaaagggctggacaatatttcaaaattattgtattatgtcattatatagttagtttcaactaaccttacagacaccattattatactaggaggagcatatatgagcgttgtcattatcggaggccacgaccgcatggtaagccaatataagaagatttgcaggaattacaagtgtaaggcaaaggtatttacccagatgagcgccagcctggataaacagattggcagtcctgacctgctggttctgtttaccaacactgtgtcccacaagatgatacgctgcgccctggacgaggtgggaagcggcacggagatcgtccgctgccataccagcagcggcacagccctcacagaaatcctggaagaaaaatgcgcggtctgtgccgtataggctttcctgtcagcggccctgcttcacctccagcatctgtaagccctccaccacggagcctgcgatgcatctggccttgtccgatatggtgaagcagttttcatattcactttttctgggatcgatgtcagcgatcttaaatcccttcactaccggatacccgtcttttatgatacccctcaaaagccctgtcagggaagcttccaccgtgacctcgccctgtccggtcacaatgactccaatggcctgtccctgcaccaccatgtccccaatcagggccttgccaaagaaaatccccttggccggggcatggatgacccgctctgccccatagccgccgattattccgggaattccggtattgggggctgcgcttccgtttccaatgatgcgtcccagattgtggcctctcatggtctctatcacaaggtccacatcccggcctgccgtaaagcccggcccgaggccgatggtcttatccgccatgtcccttgtggtccccaggttcttcttggccagtatggcatccaccagagcccagggacgcactttttcaagcactgcgcagttctcgtcaatcatgacaggcactgctccctgttccatgatggcgcaggcttcctcatagccggaagccttgatacaggtaattccctccacctcagacgtaccgtcatatactgcttcggaaaaggccacgcatctgcggattgccgaggggtatcccgactccagcaccagcaccgggtatccgcagcggtaaagcctgtggatggtaccggtggcaatatcaccgccgcctcttacaattaccagttgttttgcacgttccgtcattttacatccatttccttccatctttaattattcgtctgcctgttcagctgactgcttcagctcctccacccattcctgtgaaaaatgctgctcaaataaccggtccagttcctgtcttgtctctgccatgaaggcatcgtatgtctccagcagcctgacggcctgaggcgtaagggtggagccgcctccgtcccttcctcccgtctcccgctccgtcagcatgaacccccatgccttttctgactcctttaacatcttccacgctttgctgtaagccatgttcatggcctgggccgccccctggagggaaccggtggattccactcccctcagcagtaccgacatgccgggtccgaatgccttattttcaaaatataatttcagtgatatcccatagtgaagctgattctgttccaatgatatgccccctttttttgattggttatgtttttttaagaataacgtcctcaaagataaaagccgggcaatcgccggcttttgattctctgcgcataaagctccaaactgctattctttcactccctttattatagcagatttgtctgattatgcaattcttttttcaggctgattccctgccgtttcataacctctgccagtctttctctctgttccggctccatgggtgtaagcggaaggcgcagatcgtccccgcatattcccatcaggccaagggccgccttcaccggtatggggtttacatcccagaacagggcttccatgatttccagaagcttaagctgcatacgtctgctctccttcacatccccgtccaggtacaggcggcacatcttatgtgtctccttcggcatgatattggccagaaccgacaccacacccttgccgcccagggacatgatggggacggtctggtcatcattgcctgaatagatgtcaaatccctgcccgcacagggctgctgtcctggctatcagggacaggttgccgctggcctcctttgtcccccgtatattgggatgttccgacagaatcctgtaggtttccggctgtatggttaccccggtacggctgggcacattgtataaaaggatgggtatgctcacatggtccgccacctgggtaaaatggcgcaccagcccctcctgggatgccttgttgtaatagggcgtcacctgcagcagggcatccgcccccagctcctgggcctttctggacagctccaccgcatgctccgtacagttgctccccgtacccgcaatcaccggaatcctgccgtccacctgtcttacggcgtagcggatgacagccattttttccttgtcgtccagggtggccgactcccctgtggtgccgttcaccaccacagcgtccgtgccttcccttatcatccattccagaagccttccaaaggcgtcaaaatcaagatttccatatccgttcatgggcgtcaccactgccgcagcgctgccctcaaaaatactgtgactcataaacatcagtcccccgattcaatcattatactatgaaaatatgacaaacccgtctttatggtaccaattatttcctcctgtcatatagtgacaatatgaatccaatctcaaaggagcgcatccatgcatcaattcctcatactgggcggagattccaggcaggtttgcctgaaccggcttctcagtcagtccggagccagtacctgcttttactatgacagaccctcttcccccttctctctcagggaagccatggaagattcccatatcatcctctgccccgttccctttaccaaggacggtaaaaccattttctcagaaaacagcctgccgggcctggaaatacagaccttcacggcctgcctgaaaaacacccatatactctttggagggaatatcccttccgctgtcagggagcgctgtgaccttctttccattccctgccatgatttcatgaacatggaggacgtggcatggaaaaatgcggttgccaccgcagagggtgccgtggcagaggccatatccctaagtccggtaaatctttacagaagccgctgcctggtaaccgggtacggcagatgcgccgccattctggccgaccggttaaagggcatgggagcccgcgtaaccgtggcgggccgcaatgcctcccgcctggtcccggcccattgtctgggatacgatacctgcctgttaaaggaactgggagatgtcataggagaatctgactttatcttcaacaccataccgtccctggtactggacgctgccctggcaaaccaggttcaggaaaatgcggctgtcatcgacattgcctccgcgccgggaggggtggatttccaagcccttgaacgccggaatatacgggccagattatgtcccggacttcccggccgctactcccccctttcctctgccctgattctttatgaggccgtcatggagcatatccgggattcacagactcagtaaggaataaggagaatactatggaattaaaaggaaaacatgtaggcctggccgtcaccgggtctttttgcacctttgcaaaaatagaacaggaaatcaggcatctgaaggagacaggggccatcctgcaccccgttttctcaggaagcgtccagtccacggactcccgtttcggggataccggccagtttatggaccgaatcacatccatcgcggaaatgaagccaatactgaaaatcgaggaggccgaacccattggtccaaagggatacctggatatcctcctcatcgccccctgcaccggcaacaccctggccaaactggccaacggaatcacggacactccggtccttatggctgcaaaagcacatctgcgaaacggcaggccgctggtaatatccgtatccaccaacgatgcccttggcatcaaccttaagaacatcggcctgctgttcaacatgaaaaacatttactttgttccctttggccaggatgatccggtgaaaaagcccacctccatgattgcacgtaccggactcatagaggatacccttaaggaggccctggagggcaggcagatacagccggttatacagggggtgtagaacctttccatcaaaatttttcttctgcaaaaatttttccgctgcaaaaatctctgggggccggacccatgctgtgacagcatgcttccggtccgcagcagacgtcacggcggcatttcatccaataatatatctccttaatgaaagaacatgacacactgttgtcgtcattcatgtattatccttatagaaagaaatccatcgggccaggcccatgatgcagacggaataaggaggaataagggaatggagcttatcaaaataacacacgacaatcttgaacaggagcatatctgttgtgccatatcaaccaacaaagacattcaggtcatgacaaaaaaggcctggctcaaagaaagacttgacgaggggcttgtattcttaaaatgcaatgtgaggggaaagtgctttattgagtatattcccgccgaatatgcctgggcgccggttgaggctgacgggtatatgtacattgactgtctgtgggtatccgggcagtttaaaggacatggctactccacccttttgctggacgaatgtatcagggacagtaaagaaaaaggtaaaaaaggacttgttatcttatcttcaaagaaaaaaatgggatatctttccgaccctgaatatctgaaatataaagggtttgaaaccgcagacgtggcagacccctattttgaactgatgtatctggcctttgacaaaaatgccgataaaccatgtttcagacatactgtaaaaaaccgtgagggccttcccaggggcctggtcctgtattatacgggccaatgcccttttacagcaaaatatgtgccgcttcttgaaacagcagccaaagaaagggatgtggagcttcagaccgtacatatacggacaaaagacgacgcgcaaaacgccccgtctccgtttacaacattttcactgtttcgcgatggtgagttcgtaacccatgagatactgtctgaaaagaaatttgacaaaatcatacattagactgacagcggttaaagacaactatcctgccgcagcatctccctaagtttcacctgggcctcccgaaaccaggcatccccatcccctgaggccagcagcacataggccgtcttgcccagcagggactccagataccgtctggttcccccatccccgtcattcaggtatgcctgccttccggtacgcgtcagatgctccttcgccccatatttcatgcagtagtaaatctcctgccgcagacctcttctgtagggggcgggaacccggacccgctcattcaccaccaggccggtcaccacctgcctggttcccctggtcagaatccgggttttcctgagattaggctcaaatcccatggacctgagaaagccgtataccttacccttcacctcagaaccatcaaaaacacctgaaaatgtcatgtcgtcgcaatacctgctgtatacaatttcccgttccccgcaccaggcttccatatactcatcgaagggcttcatcaccagattggagatggccggggacgtaggcgctccctggggcagacggtcatggcagcagcaaagagaggccagcatgacacccactgccggaggaaaataggctgccggaaatgcgtgatgaagcaccatgggaaaggtgatgctcccaaaaaaatcctcaatatccatcttcatgacaatcttcctgccctgatgcatccctgcgttggcagccacagaagcccccttcctgtaagccgccgcgctgtcggacactgtaaatccgtccagcacatgatgaagcagattcctctgcacatttttcagaaggggatccggcaccagcagggtcctgaagccgccgcttctcttgggaatgctcaccttttggtaatgtttttccgcgtgattgctgagggcatagagacaacccattattttttcaggaggccagtccccggcccctatcagccggaaggaaagcatcatctccctgcactgttcagcgctgcaatatttccacaaatccgtccgggccatatctcttacctcctggaacccatgccgattctccgggtcattttccgggtcatttcacagatcatttcacagatcattttccgaattaattcctgacaaatcaaacagttattacaaaaacaaagacaggagaagcaacacgtatccggataccgtaagatgcataggggtaccgggccgcaaagcggcgggcacatgaaatgtgcggatgtaccacggcgcagcttgcggacttatccctctgcttttcactccgggcagcgactcgctgtccgtccaggcttactgcctatgcaatattcctgaaaatgctgttgcttttcctgtctttgcttatgccataatcataggcaaaaaacattggattgtcaatgtacttttatatatgtgcttttatatatgtcccttttaagatgcacttatcccttaacagcgccttccatcataccggccttctggaacttctccagtatcaggtacaggatgatgataggtatgataaccagggtggtgcctgccagtataacgggccacggggtggataatccctcactgaccggcagcagtgatatcgtcaccatcagcgtgtattttgcctgcttccttaagtaaagcagaggccagaagaaatcgttccatctggcaatcagggtgatggctccccaggacgccatggccggcttgataaccggaagaatgattttggtgaagatgccgaagtcggaacatccgtcaatcctggccgcctccaccagttcatccggcacatcagttatatactggttcatgtaaaagatacccactgccgtggcaatcctggggattaccagggaccacaggctgttaatcagtcccaccttcttcatgatgatgaacaaaggcacacttcccacctccggcggcaccagcatggtggcaatgacaaagtaaaacaggaatttcctgcccggaaacctgtattttgcaaaggcaaagcctgccagagcacagaaaaacagggaggtaatggttcccatgatggtggtgaacacgctgttgaaggcattctgtccaacaggaatcatttcaaacagacgcttaaagttagccatggtgggatttgacaccatcagggaattaaatcccgtgatgctctcgctggtgctctttatggaaatcaggcacatccacacaatgggaaacaggcagataagggtgatgaatatcagtacgccgtataccaggaccgtggacgcatttttctttctgttcattttattccctccttctatatttcgccctgcttgtgtcttaccacaaactggatgatggatatgacaatcagaataagaatcaggataacgccgattgccgatgcataacccatgttgaatacattaaagcctgactcatacatgtactggaacagggatgagttggaggttcccggtcccggaaggatataggattcattgaacagcttccacatatccactgtcagtgtcacggaacagaaaaacaggatattctttaaggacggcagagtgatgaaccagaactgctgccacccgttggcaccgtccaccgtggctgcctcatagtaatccttggatatgttgagcagtcccgataagagaatcatggtgaaccatggtgtatatctccagacattcaggataataacaggtatctttgaaaatgtggtgctggtaagccaggggatcttgctgcccccgaatattgtcaccacctcattgaccagacccacgttctcatcaaacagcattcggaaaataagacccatggcaatggctgcacatatattcggaaggaaggtagccgtcttgaaaaatgccctggcggaattactttttaagtatctgctgtttaacagggacgcgatgagcagggcacagcagataatgaataccagtccggtgagccagtagaccactgtgttgcccagggattcccagaacatatcgtcaatcagcattttcctgtaattgtcaaatccgcagaaatccggagtcccgattcccttccagtttgtcaggctgatgtagaatgtccatatggtgggcaccagctgaaatacaagaaacaggataaaaaagggcatgataaacaaatagggagccctgtattttttcagtgcttttaacattcgctgcctcctccttaaggtttataaaaggctccctcctcggggcgggagccttttttgcattactggctgatttcagccttgccgatcttagcttttaagttcttatccatgttggcgatagcgtcgctcatggactggttgcctgccacgtacttctccagctcagcagaaatgatttcatctgcctctgcatcctgaggtgttaccaccaggttagcggcgccgttctcaaggcacttgccctccatctcgcggaaggactggccgccgtagaagtcagatggctctttccagaatggatcctccagcatttccttggatactgggttggaataaggagcgttctgctcttccatggaattgacccatacttcctttgcctgggtgtcaaaggtgaaatcataccacatctggcggaacagctctgaataaggattgtcgcccttctcgatgatggccatgtactgggatacaggagcacctgccttgtcaacgccttcaaacgcaggagctgacataactctccactgtcccttggtagcttcgcagttctttctcatgaactcatcccagaaagcgccgatgcagaaagtagctacctgctgtttgttgatggcatcataaagagccggctccatgatggtggtctttaaaagaagtccctcggaattcatggtatccagggcgcccattgccttctgtgtcccttcgtcgcttccgattacaacttcaccgttctcatcccagattttagcgcctgctgacggcataagccctctgcggccccagtatctccaggtcttgctggttgggtcgatgtaggaaaggtaaacctctccgttgctcttttcctttaactggcgtcctgcctctatgtagccttccatggtcttcatctgctctgcgtccacaccgtacttgtcaaaaatctcctggttgtaaaacagcacctgaggccttacggaatccggcagcgcatagatgcgtccgccgatggtggcgtctgtggtggctccgtctaccatcttatccagaagaggagtcagatattcagtctcatcctttaaaaggcctgcgcctgccaaatccatgatggttacagggtccagcatagctgcgtcgggaagatcctcggtggctcccgacagtgctgtcatggtaatcttctcacggatgtccgcggttccctctgtctggacaaattcaatctttacatccggcgcaatatccttgtggttctccagccatgtctcaaaccactgctgtctgtactggggatttcccatggcgtaaaccaccagggttcctgcgggatatacggtcttttcaccgtccgctgcctctgcgcccccgtctgccgccccgctctggtcaccctgggcattctctgccttgggcgctgcggtggtggccgcctggtcggtcttgccgccgcaggctgcaagggagcccaccaccatggataccgcaagtgccattgctaactttcttttcatcattctctgttcctccttttgatattcactgttatcttattccctggctgcctctacggctgcctttaaaagatccatatcctgctctgttgcaagggtgcagtcagctcccagaataaaacgggttcttccgaattcccggatgaccttccttgtctcttccttcactgcctctgccggtccgtccaccagtacgccgtggcggttgggaaggccgcccatgatggtctttccagcaaacatcttccgtccgtcctctaaactgaagggagcttcatatacgccccagttcaccacgtccgcataggggccgtaatccttatagcggtccatgttcagctggtctttacagatatggaggaagcagtatcctcccgcgtccttgatggccttcataatctgcaggtcaaagggcttaatccatttctcaaattcctcatccgtgaagaacctggtctcgccgcccagagccgcataatacacaccgtccacgcccagctcaatgtatgttcttgccagttcgcacatcacgtccgcaatgcgtttcattcctgccagaaccgtatcctcatcctcacgcagcaggcggcagagcttctcccttacctggtcgtatgtatagttggggtccatcttctccaggggatggatggatgatgcggtaataccgtgaagtgtgcccaggataaatgcgtctctgtcgcatccggccagaatcttcttaaccagctccacctggtcctgcatgaagccgtccgccatggtcatctcttttaccatgctgtaatcggatccattgttaatctcgcccatatagggaaccagattctcattcatgattttaaggatgtctgtatcagattcctcaaagaatttcagatgggcttttacggccgcgtctccaaaagctgattccttaggaaaatgcagggaaaatccgctgggtatcttgtcaacttcttctccccggatagctgctgtcactctctctttttttgtcatggctgtctcctccattaatcatatcactgatgtgattagtaatcttactaatcgtgattataacactgccgacaagccgtgtcaaatattttttatccattttattaaaatttttttatcatccgacataatttttgtttattttcacgctttatgcaatttttattcaaaaaaaggatgtaaaattgacggcatcaatcttacatccttagtatttatgcattttcccatatccaggggcctgttctcaaagggaatagttctcctgaatctgctctttcacattcagtatgtccttctggagcatttccacggcccgctccgtatcatgttttaccagggcctcaatgatttccctgtgataaaagctgttggattctgcgttttttttccaggctgtctgaaaatattgggaaatatacgaacaggatttttgaagggctgcagcaatcacatcgcatatataaccgttcccgcccatctcacagagcttcaaatggaaatccgtgttccggttccaatgaatggccaccatcctctcatggttatcctttgtgatggtatccagctgtcttaaatcttctatctgctcaggggtaattctctggcacagccgcctcaggttgcctgtctccacatcaattctgaattccagaagatccagtatctccttcagggtcacaggaaccacctgatagcccacccttggtatacttttcaggacattatccttgcacagttcaataagggcctcccgcaccggtgatttgctcatggcgtacttttccatgatttccccttcatggatgatatcgttaggcttatagatgccttcttctatctcccggtagattccctccaccacggtttctttcagggtttttttcatcttcatcttcttttctccaatgccttcccttttttataaacccgttccgccagcctgtaggatatatcataggccatggacacatccccttccatccagtccttccctgtccagagctgcctgaatccactgaccgcttcctccgtcatgccccccggcgtggcgtggtccttaagctttgcttccaggaactccctggtctccagctgcaaagaaagaagatgcagctcaaaggacctgggggcaataatgtccgcgttcccggccgttcctgctctggtttcattcccatttccgtttccgcctttccggccgtcatatgttccgggtttgtttccggcctccccgcccgccccgcgggcaaaggccagggcgccttcataccagcccttttccagccagaccagcctgtccatcttctgcccatccatctgctgcccgtccatctgctgtccgcccggcgctgcggcaggcgtaataagaccgggaaggcccagccttctgcggttcagcgcatacaggatgccggccgcccgggcgcagccgccttgaccgctctcatccccataatgcgattccagcccaaaacataagaggtacagcatatgataggtaatgctcatggacagcagacgcagggattcatccggcgtacattcaaatacctgtcctaggggtttgagaaactgtctgaccgcgtccagctgctccctgcccggaggacagccggggtcgtatgtaatcttattgaaagccagtgaatacacatccaggccgccgatcaccgtctccatggccggcaggatgcatacggtcctgacaccgtcacccaggatcctggtataccattcaggacgcggactgggagcaaaggagaacagcagcaaccctccaagcccttgttccctgcggtactttacatagggcttgatggtatcctccgccactcccgccacctcatggggcctgacggaaagcaccagtatgccgggcttatattccttcagcttatccaggcaattgcccgctatgatttcaaagccgtatctgtgcctcagctcttcaatccccctggaaccggccttcaccgcaaacatccgcttttcatatccttctcccagcaggcttctgtaacagggaaccatatacgccccaatccatcccatgccaatgacagccagcctgtccgctccatcacccatcatatatttccatccttttacaactacatcctaaaattataatctgaaatgcgtcaggattcaataggggggattataaaaacagctcattttcccgtctgatatccctgacaggggaaagcttctgctccagcatggcgcaggcctgctcaggcaggcttctggccttcaccggacagacggaaatacagcgcatgcagaggatgcagcgcgcctggtccgtggaggaaggattgcttacagggatagcctgcacaggacatctggcagcgcacagcccgcaggatatgcaggatgcgttggtaaggggaatcaccggcatctgcttccagtcacggtaaggacggtttcccggcacctgaggctcctgccagccctcctcttccagcttttcaagtatcctggccccaaagtcagccatttcctttcggtcctgattatccggccggccggccgcaacatcccgtaccatggaatgttctgccagcagcgctgtccctgccccaatcctgaacccctgggcctttaagcagtcatccagttccagaagggcatcctcaaaagccctgttgccgtagactgccgcagtcagcgccactgccccgccgcctttcaggtatgtaagcttttccgccgcatatccgggtatcctgccgccgaacacgggcacgcccacaatcacggtgtcctccgacccaaaggaatactctccctccaggctgcaaaggtccacatccttgaccttcttccccatctccatagccagattgagacaggccttcctggtgccgcctgtggggctgaaatacacaacggttatatgttccatcttattcatgctgttacctccggaattttgtatgttggttcgatattctagttattttatcacattccgggcggaaaagcaccatctgaaaaacagaatctgtgccggcctgtaccggaatccattccggtttaagtccggacagctctcccctcgtgcagactgccgcccttcataaggaaaagcaggcgttttaccgcctgctttcaaaaatctagtcaaccaccaccctggcataggaggccatggcctcctcgctcatctcctggccgattccgggcctgtcattcatctcgtatctgccgtttaccggagcccaggcatatttccccgctttctggtaatctgttttgaaattagcgcagtgctcctcatgaatgacaaaattaggtatgacggtctccacatggagggccgccgccgtggcaatgggcccgccgcacacgtgaagctggatgccgatatcatatacattggccatatcgcagattttctttacttccgtgatgccgccggtattgcacagatccggctgggcgatgctgagtgtcctgtcctcaaagaactgcctgaatccccagcgcgtatagctcctctcaccggttgcaagggggatatcgcatttctgcttgatatgcttaaatacctcaggattggaaggcatggtaggttcctcatagtacatgatgcggtaaggctccagggattttcctaaaatcacggccgtgttggcgtcaagggtggaatggatctctatgataatgtcaagctcgtcccctcccgcctcacgggcagccgcaatgcgctccaccgcaattttcctcaatgcttccggataagctcccttcagattgtcgccgcgttttaagtacgcctggttaaaatcctctcttgataatccggcaaagcacgggtcaatcttaactgcatcgtatccgtccgccatggcatcctttacagcgtcatagtaatccttcggttcaaactgaagctcagaccggtccagttttgtaataagggtcctccaccccatctgcagctgggatgcgtacgcccggagggaatcatgggtctttcctccaaggagcttataaacaggcagccccaaggcctttcccttaatatcccagcaggcaatgtcgatggcggccatggcggcagataccgtaacgcccccgttcatgccccagaacgtatggcggtggagatgttcataaattttttccgtgtcaaaggggtccatgccaatgaccattttggcaaaatcctgacaatttccccacgccgcattctggcagctgccgtaggaaagcccggcctctccaaaaccgctgattccctcgtccgtgtttaccttaaccgttatgaacgctcctttatagcattccacacttgtaatcttcatcttctgatttccccctttaattaagtgttatctggtcttccgatgcaagcgccttgtcagaccattcgtttccaatgccaatatcgtccgtcacgtccagatacccattcttcggcatcactacctttgctgtaagttcctggttggaaggattcatactgcgcatatgctgttcgtgaatgacgaaattaggtatacatgcctcaagctgtacagacggcggcgtcagcagatgggacgcgcatgtatgaatctgaacacccacatcaaaagtatacgccatatcgcagattctttttgtttcggtgattccgccggcattgccgatatccggctggattacctgaatggaattatccatgaaataccgtatgtattcccatcgtccgaacacccgttccccatgggccagcggcatttttacattatcctttacatatttgttattgtagaatacaggtgtgttaggttcctcaaaatagtaaatattacagtcctggactgctgccgacagctggattgccgaattggaattggttcccgcgtggttttcaataataaggtcaaccttggggcctatggcctccctgacagcatggacacggtcggagaaaacctgtacaagctcaggaggaagcaggcccagacggttggtctcattcaatatattgcccttttcatcccagttaaggaaatcaatcttaatggcatcgtaaccatcctgaagggcaagcctggccctgtccacataatcctgcacggttacggccggggaatctattggcccccatccaaactgcagctgtgaggcatagcagcgcaccttatcccgccgctttcctcccaggagtttatataacggcacatttagcgccttgctcttgatatcccacagggcgatatcaatggcgctgactgcgctgtaccagaaggcaccgccgttttgaccccaaaaggttctgagcatcagctggtcccacagcacctcattgtcaaaggggtcttttcccgagataaaaggccacatatcctttatcacgccgaaggccccgtaggtcgcgtgaattcccgccacctctccgtccccgtaaattccttcatctgtataaatacggattcccacgaccttactctttttaggaaactcaggcgtttcagaacggttgtattcggccaggaataacttcgcgcttgttattttcatatttttcctccttgtatcatgagcttttgtttataaatccgctaatagaaaatctgccccagcagcagtccgtaaccatatgcaatgattgaaaatataatgaccggcacaagggccctcacaacgatgtctcccagtgtggtgtggtaaaaatcagccgcaacaaaggaacagacgtgggtgggagatatctgcattgcagcccacgcgacactcatcagcatgacaagaaacggaatccctccctggggaaacgccaaaaacgccatgggcatgcaaagagcaatgattgtctgggagccgcttataactgtgccgataaagaacagcaggccgaaggacattgtcatggaaatgggaaactgtcctataaagtcaggcagaagccctatgacgccggtatacgacaatatgcctttaaaaagcattatcaggtacatgttgcccaataatatgggttccgcagacctcaccataagatccggaaaatcttttaaactgaaatgatcaaatatataattggcagcaattaccaggggagcggctatgcacacggaaagattaaatataataatgattaagagcacagctatcagggtccacaggtttttcaccagattgataatttccgctttcttatcaatggtctcttcaagcaggggcatttccctgggtattccttttaaatgtgtaatatataccacaagacatgccgccaccaccatgggaatcatggccagcacaaacacccccgcattctgtccgctaagtgtaagtcccaagaggactgccggaaaggttggaaggaacatttccggtatatgtctgtaatagcaggatacaaacgtcttgtttttatcatccatgtattccccgcatgtcctgtctaccatatccgcgcagattgtcatgactgccgcagacggaagaagtcccataattgcaggtgatacaatggtattcattctgcgattcctgagcaggcggttaaatgaatccttcgcgtttgtcagccttccttttttctctagcataagctggagaaatatgatgagatagaagctcagcagcacatctatggtatcccaggccactgtctgccttcccagaacaaccgccgcatccttcagattgatccggaacaaaataacggcagctgctatcccccctgtcattgccacaaacagcggctttttcagccatataatcacaacgattaccagaaacactatggaaagatataggatatccatgtttcctccttcatgccctccatcatatcctgccaagcagcagaagtgaaatggccggaataaatgccaccacgaaaaatgctgctatcagaccaaacagaaggggcatttccgcttttgtaatcttatctatactaatacctgtcagggatgagcccacaaacaggttgattgccacaggcggcgttacaaaagcaatagccagggccaggtcaaggatgatgccaaagtgaatcgggtcgcatcccacctgggttaccacagataaaagggtgggagccagaatgatgatggctggtgttgtctgtataaacattcccacgataaacatgataacgaatatcatgaacatgaccacatagtaattgctggagatactgaacatgaaatcagcaatggtctggttgatgttcagatacgcaaatacagatccggttgcctttgccggacacatgatgaacatagtaccggctataaacgcggcattgtcccggaatacggcccatagcttttcaatttttaactcccggtagaccacgaatccgataaatatgccatacacaacagccacgaccgctgcctctgtagcagtaaaaaagcctccataaattccgcccagtataataaccggcatgattaacgcccactttgcatcccaccaggcacggaaggctgatttcatttggaaatggttctcgcctttcagatggtgttttttacagtacgcgtaattgataaggataagcactccgcccaccacgcaggacgggagcagaccggcaatgaacaggtctcccacggactggttacaggttacaccgtacagaaccagcggatagctgggaggcacaatgactcccagaccgccagcacagcatgccagagccgttgcataatacttgctgtacccttcctgcaccatcataggtatcatgatggcgccgatggccgccactgtggccggtgcggaaccggacactgcgccaaagaacatgcatgctatgaccgtaaccattccaagggaacctgtaacaccgcctatgattgaattggctgcactcaccagacgtttggacagaccccctgtttccatgatggtacccgaaatcatgaaaaagggcagagccaggttggtgaagctggcaactcctccatatgtagtctgggcaatgaatgaactggtggtaaccggatcaatatttatcagcacaaacatactgatgaacattgccactgcaatgggcacaccaaggaacatgagaccaaacattacaataaacataacacctgtagccactatctcacctctcccttcacggcagccgcctcccttgccgccttcttttccagataaatccgctcacattcatcaaggtccatcgcaggcttggaagcgcccagattggcctcattctcatgcatgagttttatggtatcctgtgcgattcttacgacgctgagcaccagcccgataggaatgatggagtataccatctgctggggaagcctcagcagcgtggtctgactgtttccaagtctcccgataatggtcatgacaatatacagcaaatatatatcaaaagcagcaaagaccagattggagatgacaagcattgcctttttcaccttaaacggaaccatttcaagtataaagtcgatgcgcaggtgctttcttttggtgacagccgcggacatggcaaaccaaatcatccacacaaaggcaatggtcgcaacctcctccacccatgcaaaggaatgcttcagcgcataccggcagaacacgtttgcaaaaagcaatacggtaagggctatgaataaaacagccgatatatacagctctatattatccagaaaagtcttcaggtcgaactttccatctttcatacgatctacccccgcttatttctttgcctggtaatccagcacaaaatccaccagcttattgtaagcttctgagcccatctgttcttctacctggggccacacagacttggccacatcctggaataccttgagttcatccgttgtcagttcaatcaccgttgtaccctttgactgcatctcgtcgaagaatccatcagataaatcttcggtcagggaacggacatacatctctgtctccttccaaaggtcctggataaacgccttgtcctcctccgtgagcgtactccagaataccggactggcagccatgattgtggttgtaaaattatggttcgtcttcatacagtagctctgcatctcataaatcttggaagaaacaatgttggagggcggattctcctgggcatctaccagtttctgctgaagggcggtgtagagttccgcatagggcaccggcgtcacgctggccccaaaagcttcccagcagttcatttgaatcgggtccaccatggtgcggattttaacgccttttaaatcagccggggaatggatttccttatttgctgtaagctggcggaacccgatatccaggtgggcaagaggaatgcactgtgtatcggcctgggcccgctggtcccactcctggcgcagcccggaatccaggaccgcatatgcgtcgtcataatccatatagagataaggaatatttaagcctgcgtaggccggggtataatcagcccatgaaccgcagttcagcataaatatctcatacgcgccattttgggcaccgccaatatattcctgagtggaggacgccagctggccgtctgtgaatatctgtgtggtaatgcggcccccgctgcgctcttcaatctgtttgcagaaataaatcattccctttccagtctggctgattccgtctccggccacatcaccggctgatgcattggtggcaaaacggattttaaatggctccccctgtgtgtggtccactccgtccgcccccactgaacccccaccttctgatgccttggaatcacctgctgtagtggcggcagcggcagttgttgcggcggcactgtctgcattagagtttccgcaggctgccagcggcagcagcattgcggttgaaaccatggctgcaatcactttcttcatcacttttttcattctagttcctccttttgataaaattgttgtctgaaacctgccttaatcaaaccgtgattcctaatatttttccttatccacccccacctgcttgaatatattgataattcaatctataattatagtgtcaacgagtatatttactgatttatttaatataattcaaccatatttatgcaattattacaaattacttttttttgccaattaataacttttggaaataggagggcgtatgaattaccagcatctggaatactttcttaaagcagctgaataccagcactacacccgggccgctgaacatctgcatatcacacagcctgctcttacaaaggccatacttggcattgaggaagaaatcggcgcacctttgttcatgaagcggggccgtaatattgaacttacgaaatatggaaagattttttttgattatgcaaggcgttcccttgaagaaatcaaccatggaatatccgccgtaaaacatcaggtcaacagtgatctgaataccgttaacctgtctgccttatgctccattaatacgacctttttgccgaagaaaagcgcgcagtttcaccttgcctatcctgactgcagcctaaacatcacttttaaatatacaacagctattatcaaggatgtatccaactataacagcacctttggtttatgcggagagtttgacaatgaatctgaatataccagcctggaaaaaatcctgctttacacggaacccgtcaaatttgtcataagcaggaatcatcccctggcgcacaaaaaatccgtagaggccgccgaactgaaaaaccaaccgtttgcagtctataacgtgagcaccaacggtaccaacaggctgctctatgaattatgcgacggcgccggattcagacccaagaccctgacagccgcttacaatgactatggactgattaacgaggtgatttcaaaccaatgcatctctattgtctcctataccttttataagcaatttcaaagcctgggttttacggaactgcacatcgccaccagtatcccccttatccagaaaatatatctggtatgggtcagggacgcaaatctttcccctgtggcaaggggctttcgcgagatactgatgagcaaatgaccaccctcgttaaaaaaaggcataaaaagggtgcaaacgcagataaatgatccgcatttgcacccttttcccaactttccagccggttttattccaccgttattccccgctgattacagcgcatatctcccgcgcttcacaaacttcccggccttctccaccaccacctgatggtccttcaccacctgggtaccgcgcaggaacacgctctcgatacgtgccgtcagcttccttccctcaaagggagcgtaatccacattctgtacctggtccgcagccgtaaccatatcctccacaccggtacgcatgacaacaatgtccgcgtcgcttcccggagcaatggctcccttggcgggatacattccgtacagcttggcaggattttccgacaaaagctggcacattttttcctttgtaattcttccggcgtccacgccataggtgtagagcagtgtgccccttgtctcaactccgggcatacctcccggaatctttgtaaagtcatcctttcccagtgccttctgctctgtggtaaagctgcagtggtccgttgacacggtctggatggtcccgtccgccagagccttccaaaggcacgcgctgtcctcctgtttcctcagaggcggcgcgcacacatacttggccccttccatgccggcaagcccgtacaggctgtcatccatgagcagatactggggacaggtctccgcatataccttctgtccccttctcctggcttccatgatcacgtcgtatccctcccggcaggtgagatgcaccacaatcacagggatatccaccacctcagccagcctgagcagcctgtcaatggcctctgcctcagcagccgccggccgggtggccgggtggctttccacgcccattcttccggcagcctttgcctctgcctggagggcagctatcataccgctgttctcacagtgaacaccggtgattcctcccacctccttaagcctgcgcaggatttcaaaaattgtctcgtcgtccacctgggtatcgtatgtcatgtacagcttaaaggaggtgattccggcctccatcatgtcgtcaagttccctgctgaccgacgggttccagtccgatatggacatgtggaatccgtaatcacaggagcacttgccgtccgccttctcatgccagttcctgaggccgtccgccaggctctccccttcatactgggtcccgaagtccacgatggtggtggtgccgccccgaacagccgccctggttcctgtggcaaaatcgtccgcagtaaccgttcccgccacatggaggtcaaaatgggtgtgggcgtcgatgaaacccggaaagagcagacagccttccacatccacaatctgggtatcctcatctgccaggcgctccatttcctcaccggttcccactgccgccaccttttccccgtcaatgagcacatctgcccggacactgccgcttccgccaactacggttccgccttttaataccttcttcatatatatcactctcctgttctgtttctctctgtcaatctaacgatacgttccggcttttttccctttttcctgtcaccttgcggacattccggcccctgtatccatctgccgcctatgggcatctgccacctgcgggcatctgtcacctgcgggcatcagccgccatggcctccagccgttccccgtcaatccggtacacggtccagtcactcatgggccgggcgcccattcccagataaaagtcaatgcttggcttattccagtccaggcaccaccactccaggcgtccgcacccccgttccacggcaatggctgccagccggttcaaaaaggcggtgccgaagccctggccccggtactccgggcgcacatacaagtcctccagatatatgccggcccttcccagaaaggtggagaaattatggaagaacagagcaaatcccactgtctccccgtccttcatccccagaatcacctctgccttttccttctcaaacagccactggttcagcagctcctctgtagccaccacctggtcaagcattccctcataatcagccagctcccttatgaacctgagaatcaagggtatgtcctgtggtttggcaaaccggaattcaacggccttatccgcccttttatgttccattccatgccctgtcttgtcaagggtgttgtccatgatgtcatctccttatgcggaacaagcgaaaagcaggtggactgcctttcgccgttcatttccaatgttatttttactttttctttgaatagtacgtgtcatccatgggaagcgttgtcctcagcacatggtcctttgcataataagctccctgtgccgccggagcggttggtatggtggcaatttccccaatcccctttgcgccgtaggcaaaggacagcagttcttccttctccacatagattgcatggatatccggaatctgggtggagcgcatgagtcccagggtgccgtatttagcctggggaacaccgttctttaaggggaagtcctcggtcagggcgtagcccagtcccatgagaacgccgccttcaatctggccctgtatggaaataggatttactacctttccggagtcatgggcagcatacacttcctttacccggccgtcgtcgtctaacaccaccacatgggttgcaaatccgtaagccacatggctctttggattgggcacatctgctcccagcttatctgtggggtcaaagaattccgcaaagaactcacggccttccagcaggcttaagtctcctcccgcttcctgcaatgcctcattcaaatcagccgcagccatcctgacagcctcgcctgtaatcagagtctgacgggaaccggatgtggttcctgaatcaggcgccacctcggaattggcccccatattcctgaccatttcctttccaagccctgttgtctcggaaaccatctgtacgaatacggttgcgcacccctgcccgatatcggaagcagcgctgtacagctcaatctttccgtcgcggaccgccagctttgcccggcctttatcgggaagtcccacgcccacacccgcattcttcatggcacaggcgattccggccctgccgggattgctctcataggcatcctttacagccagaagggtctccttaagggctgtggagcagtccgctatctgcccgtttggaagtaccttgcccggttcaatggcgttgcggtagcggatttcccacggggaaatacccaccttctccgccagcagattgatattggactccagggcaaattcactctggcacacgccgaaaccgcggaacgcgcctgcgggcggattgttggtatagtagccgaagccgcggatatccgtgttctggtagcagtaaggccctacggagtgggtacacgccctctcaagcacaggtccgcacagggaagcataagctcctgtatcaaaataaatctcacaatccagtcctgtaaatataccgttctcgtcgcatcccagggtaaatgtcccctccatggcatggcgctttggatggaagcttaaggattcctgtctggaaaacaccacctttaccggcctctgcaccttaagggctgccagggctgctatgtgctgtgcggatacgtcctccttgccgccgaagccgccgcctaccagcttgttttccacaaccacccggtccggatcccagcccagcatgatggatatttcctttctggtatcgtagacgccctggtctgtggaatataccttcacaccgtccttgtaaggaaaggccaccgcacattccggttccaggaaagcgtgctcggtaaagggcgtacggtatgtctgggtcaccacgtatctggaattttccagggccttctttgcatccccgcgggtaacgtggcggctctggcacagatttcccttctcatgtaccctgggcgcgtcctctgccatggcttcctgaatggagcacacgggtttcagctcctcataatcaatcttcaccatccgctttgccttctcaaggatgtccctggactcggcaaccaccagacagatggcgtcgcccacacagcgggtgatatctccctttgcaatcattacgtcccagtcctgctggagatggcccaccttgttattggggacatcctcggccgtgagcacggccagcacgccgggaagggccgctgccttctcgcagttaatatccagaacccgtgcccgcggatactgggagcggacagccgaagcatataccattccctccatctccacgtcatccgggtactcgccgtagcccagcaccttttcccgcacatccaggcggaaggcacgctttccgacgccgtactcatcccccttttccagggactcctcaatccgggcgtcgcctctcagaatggctgccgtcagctggatgccttcgataattttcttatatcctgtacagcggcagatatttccctttaacgcaaccttgatttcctcctcagtagggtccggaacgcggtcaatcagagcctttcccgccatcaccatgcccggcgtacagaatccgcactgcacggatcccattgccccgaaggcatacacaaaggcttccttttccgcgtcgcttaatccctccgtggtaatgatgtttttgcccactgcccgcctggtggtcaggacgcaggacttgaccgccttgccgtccaccacaatagtacatgtgccgcaggcgccttcgctgcacccgtccttgacagaatgaaggtgaaggtcgtccctcagatagcgcagcagcggtttatcctcgctggtgcagcgttccactccatttactgtaaaacaaaagttctctcccattttatgcctcctgcctctacgcctttaccgtgaaaatgccgtcggcatccagtataattcctcttggacatttgactgcacacataccgcaggcgatacactttgcttcatctattaccgcgtggttattctctatcctgacggcatccgccggacagttctttacacagataccgcaggcaatacagcccaccgaacaatccttccttgtctgggctcccccgtcctggttcatacatgccgtataaaccgggtattccggcgtggtaatgcgaatcagaccaaggggacaggctttcacgcacaggccgcaacccacgcatttgccccggtccacctctgctgctccaaagctgtttatgtggatggcgtccgacttacaggcagccacgcagctgcccatgcccagacatccccatttacatttcaatatgccgtccggatggtctgccaagacctggctgcaatcccctgccaggtccccacggggaataaccgcctctgcgtgacagccccccaggcattgcaccacggctacttttctattgcgcttttgtgccattttgttcttctcctttcattattcttgcaaaagaataacgctacttttttaacaagcctttgccaaaggagtccccacattttcattgaggactcctttgtacggcaattcgcacacattgtaacagttcagaaatccgatgtgaactgtcaccacacattatctacagcatatatgaatagtcgttgatgactgtccggatgatattctggatgccgtccggcacatctgcgtttacggtaccaaccgtgtaatccatgatcctgccctgaagccttaccctgcacacaccggcagcagcgtccagtaccgtgaagccctggtttttgctgttttccatgtcagcctcgttggcaaacagggtgaatttgtcaagatagggagcgctgtcccacggacagaagctcttacagttgccgcactcgttgcacatataatccacgtggatgatctgatgcttctccatgcccggaacaaccagggagatattggctctgttggggcatacctcaacacagttttcgcagtagctgttgcaggataagcagcgggcgctgtcaaccacatggtcattttcctctgccagcctgcccttgcgtccgtagatggtctctgcatcagagagcttgaacaggtcctctgccagggcttttccgataatggcctccgcagccatcttgccgtccctgattccttccaccaccgtggcaggaccgtacaggccgtctccggccacatagacaccctttacagaggtttccagcgtctcctggttcacctggggacgtcttctgctgtccagggcaatgccgaaactctcatagaatgcccccggaaccttctcgcctacagcggcaatcacggtgtcggcaggcacttccactgtctcatctgtctccaccacgccccggcgtccgctggcgtccatgtctcccagcaccatcttcttacagtacaggactccattttccagcttaacaggagccaggagctcagcgaattccacgccgtcctccacagccatgaccagttcttcctcatcagcaggcatgtagcgtctggttcttctgtataccagggaaaccttctccacgcctgcgtttctcttggctgccctggccgtatccatggctgtgttgcctccgccgatcacaaccacgttcttacctaattccaccttgccctctgttgccttaaaccgtgccaggaaatccagtgcgttcatggtatcccctgcctccagcttaagaacgccctgctcggacgcgcccactgccaggacaacataatcataatccttcttaagggcctctatatcggtgatttccttaccgttcaccatctccacgcccatggctgccaccagcttcacgtcgttgtcaatggcactgtcgctgatacggaatcccggaatcacgttgcggacaacgccgcccatcttctcttccttctcaaacagggtaaccttcacgccgccccttgccaggaaataagctgccgccagtccggccgggccgccgcctaccacagccgccttcttatcagaggtaacctcaggcgctttgagcttagccataaccgcctcaaatccgccctctgcggcctccagcttggtcctgcggatatccactggggactcgtagaagtttctggtacacttgctcatacagttgtgggcgcagatagtacctgtgataaagggcagcggattcttattgagaataacctccagagcctgctcaaactcacctgctcctgccagctgcaggtatctggtgatatcctgatggatggggcagccttcctgacagggggcgatgaaacagtcggtaagcggaaccggccggttgattttcctggaaggaaggggctttaccgcctttacatggtgcttgtcggatttcacagcctccaccagtccggttaccctggcagcatccacgccctcaaaggcagcagcttccttggctgcaaataactgtccaatctgctccagtctctcataaccgcccggctttaacatggtggtggccatggttaccggccagatgcctgcatccacgatatccgcgatattaaagaagtcggcgccgccggaataggaaatgcgcagcttcccgccaaagtcctcagccagcttcccggcaacagacatggaaaggggataaagggactttccggacatatacatttcctcgctgggaagctcgttctgctttacgtcaacagggaacgtattggtaatcttcacgccgaattccagtcccttcccgtctgccagggcctggagcctctggagcatgggaaccgcgtctgagtactgtaaatcatccttaaaatggaaatcgccaaaggcaacatagtcatatcccatatcgtccatgatcttccttgcgtactcatatccaagcagggtggggttgcatttgatgaatgtatgtaccttcttctcctcaatcaggtatctggcgatgcgctcaatctcctggggaggacatccgtgaagggtggaaagggttgcgcagttgcataccttaggagatatggcttccacatcctccctggacaccttctcaaaccggtccagattgtcaaggagccactgcctgcactctttgaaaatggcggtctcggaagcatccttcatgccctcaatgaaacggtcaattttctctgtcttgatgccgtccaggtcatatcccacggacatattgaactggaagccctcaggactgcccagtccaaattccctggccagcaccttgcaggcaaaccaggcctttacatactcgtcaaatgcctggggcacatagagctctgtggaccactcgcagttatagcactcgtcgtcagccttgatacatggtttggatacgggaaggtcctcgccgtccagcttctgtacggtcttaagctcgaagaaacggctgcctgccacgtaggaagccacgatattctgggtcagctgggtatggggtcctgctgcgggtccgaagggagtctccagcttacggccaaaaatctcataggttttgtccgggtctgcaatgaatggtctcttgatgccaaatacagcgcccttcttgttctcttcaaggatccagttcatcagttttccaaatggaatcggggtcataatgtcgctcatattattcttatcctcctttataaccagaccaggtcccagcaccggataccggggacattgtccccgggtcctccatccggctcagccgcccgggagacattgtcgtcccggggtgctgctttcccgccgccctgcaatcggatatcacttataaattatacattgcgtatgcgttgtttatatataggaaagaccagccatccctggaaggcgtttcctatggatgccggctgctgccccggcaattaaccgttgatggaatgggccagcttctttgcctcttcccttacctcataaaggatcttctcctcatccagtcccacaagctccctgttcttcatcagaaccttgccgttgcataccgtggtcaccacgcttcttcccgtcatgccgaacaggatgtgtccgtttacattggacgcgtccattggagtcagcgggatatagtccgtgacaatcacgtcagcggcagcgccttccttcaatacgcccagctgcttcttgaagtagcggttggcaatctttgcattgccctcaaagagcatctggggaacctcgccccaggccgcattggcgtcgcagaggtgatgtttgtgaagaacattggctaccttgaaggattctgtcatatcatgggtgtaaccgtctgttcccaggccggtgagaatgcctctgtgcacgatctccatggtaggcgggcatccgcaggcattgcccatgttggactcagggttatgtaccaccatggtatccgtatccttgatcagctgcatctcatgaggatttacgtaaatgcagtgggccagcagggtcttttccccaaggatattgcagtccatcagacggtccacaattctctttccgtacttcttaagacagtcgtggagatcctcgatgccctctgccacatggatgtggtatcccacctcagccggcttgttggctgccgccagctccatggtctcatctgagatggtgaactgggcgtgcattcccatcatacccgcaatcatgtccgtgtcgtccgccagggcgtgtttgatccaggacgcgttttccataacagccgccctggccttatccatgccgtccctgtcggaaatttcatagcacagacaggtcctgacgcccatctccttagcggcgtcctcaatggcaaacagggaatcctttatctccccgaagctggcatggtggtcaaatacggtggtgactccgttcttaatggaatccagataagtggccctggcgctctggcgggtctgttcattggtcaggtggcggtcaatggtccaccacatgccgtccagaatatccagaaaccctttggggtcatatcctttaatggaaagacctcttgccatggcactgtagatatgctcatgggtgttgatgaaggccggcatgatgacgcccccctttgcgtccacatattcggcatcagggaactccttcttaatctcctccagtgtgcccaccttctttattgcggtaccgtccattgccactgccccattttcaaaaaatggctgttctgggtctctggtaaccagacgaccgttcccaatcactaacataacctctctcctttgctttttattattttatgtacctgctctttaaatctgtcctaaacaccatcgggatttcataaactttaataagatagaacaggacttcctgtacccctatactaacaccatacaaatccatttgcaagcagaaaatgcaaaaatttttagatattcaaaatttttttgtaaaaacctcttgcaattccttttttttgtgctatgatggaatcataaacaacgcatcacaactttgcgaaatgtttattgtacaaagtcaccagatttgaagagtccgaggaaaaggaggttaagccatgtcatacacactagatttactgaaacagcttgctgatggccttgcgagacagttcggacctgactgtgaaattgtcatacacgaccttgaaaaacacgaccttgaacattccatcgtgcacatcaacaacggtcatgtgacaaaccgccaggaaggggacggaccttcaaaagtagtcctggaaacccttcacaaggatccggcttctttaaaagaccatcttggatacctgacccgtacatccaacggcaagatactgaagtccagcaccatctacatccgtaatgaggaaggagattccattgactatcttctctccattaattacgacataacaggcctgatgactgtggaccgttccattaaagctctcatcgacaccgaaccccaagcggacgtgaagcagcagcccgaacagattgtccacaacgtcaatgacctgttagataccctgattgaacagtcggtggcccttatcggcaagccggccgccttgatgaacaaggaggagaaagtcactgccatccagttcctgaacgatgcaggcgccttccttataacaaaatcaggggacaaggtttccaagtacttcggaatctccaaatttactttgtacagctacattgatgtaaacagccgcaagtcggaagataaaaaagcgtgatgataattaaggaggattatgtaacatggatcagaagattctatgggcggtcaatcaaatgcctaagacagatgacaagaacctgccgattatgggactggaggagattgcaaaggcgaggacattccacgaaagcttcccccagtacaccaaaacaccactcaccaagctggaccacatggcagcttatctgggagtaaaggaaatctacttaaaagatgagtcctaccgttttggcctcaatgcattcaaggttctgggaggttccttctccatggcccgctacattgccaaggaaaccggcagggacgtatccgaacttccctactcagtcctcacttctgaccagttaagagaagaatttggccaggctaccttcttcaccgccacagacggcaaccacggacgcggcgttgcatgggccgccaaccgtcttggacagaaggcagtggtacatatgcctaagggttccacccagacacgtctcgagaacattgccaaggaaggcgctgccgtggacatccaggagatgaattacgatgactgcgtacgtctggcagccaaggaagccgacgaaaccccaagaggcgtcatggtacaggataccgcctgggacggatacgaggagattccatcctggattatgcagggttacggaaccatggccatggaggccggcgagcagttaaaggaatacggctgcgagcgcccgacccacatctttgtccaggcaggcgttggttcgctggcaggcgctgtggtaggctacttctccaatctgtatgctgataatcctcctgttttcgtagttgtggaagctgaggcagccgcatgcctgtacaagggcgctgctgccggcgacggacaaatccgcatcgtggacggcgacatggaaaccatcatggccggccttgcctgcggcgagcccaacaccatttcatgggatatcttaaagaaccatgtcaaagtattcatcgctgcccctgactgggtagccgcaaccggtatgcgtatgctgggcgctcctatcaagggcgacgtgcctgttacctccggagaatccggcgcagctccattcggcgcactggcagccgttatgtccatggatgaatacgctgagctgagaaaagacattggcctggatgagaattccagagtactgctcttctccactgaaggcgacactgaccctgaccgttacaagaacattgtatggaaaggtctggataaataacaatcacctatatcacacccaaaacaaatatcaatgtataatggaggaaatgaagaaatgaatctggattacgcaaaaatcaaagaagcagcaaagaactatgaaaaagacatgaccaagttcttacgcgacatcgttaaattcccgggcgagagctgtgatgagaaggctcacatcgaccgtatcgctgaagagatgacaaagctgggatttgacaaggtagacatcgaccccatgggcaatgttctgggatatatgggaaccggcgagaccctcatcggctttgacgcacacatcgacacagtgggcatcggcaacaagaacaactggaacttcgatccttatgagggctatgagaatgacaccgagattggcggacgcggcgtgtccgaccagtgcggcggtatcgtatctgctgtatacggcgctaaaatcatgaaggatttaggaatgttaagcgataaatatacggttctggtaaccggtacggttcaggaagaggactgcgacggtctgtgctggcagtacatcatcaacgaagacaaggttcgtcctgatttcgtagtatccacagagcccaccgacggcggcatctaccgcggccagagaggccgtatggaaatccgcgttgacgttaagggcgtttcctgccatggttccgctcctgagcgcggcgacaacgctatctataagatggctgacatccttcaggatgtacgtgctctgaatgaaaacgacgctgctgacgacaaggaagttaagggccttgtgaagatgctggatgagaagtacaatcctgagtataaggaagccaacttcttaggccgcggcactgttactgtttccgagattttcttcacatctccaagccgctgtgcagttgctgattcctgttccgtatcccttgaccgccgtatgacggcaggcgagacatgggagagctgcttagacgagattcgtgctcttcctgcagttaaaaagtacggcgatgatgttaccgtatccatgtatgagtattcccgtccttcctataagggccttacatatccaatcgagtgctacttcccaacctgggttatcccggaggaccacaaggttaccaagtccctggaagaagcttataagaacctgttcggcgacgagcgtatcggtgtggacgcaacagcagagatgagaaaagcacgtcctcttaccgataagtggaccttctccaccaacggcgtttccatcatgggacgcaacggcattccttgtatcggttttggtcctggcgctgaggctcaggcccatgctcccaatgagattacatggaagcaggatctggttacctgcgcagctgtttacgctgctctgcccagtgtttactgcaagtaattacctacctttgtttattgtccgcagggtgttgtcccggctgctgttaaaccgcggcctcggtccgctggcccccggagccgttcttctggcctgaggggcagccgggaagcatagggcacacgcccttcacactgctcattcgtttaccgttttccatgaagtcctaagtgacctgtttgtttcggcggtctatgctgaaggccgccggaacggctcaggcccgcttacattcatgaaagaacggatatcccttttatttttgtaacatccaacaacgatacccaaattaaaaattaatataataaaggagtcaatcaaatgaaaacattacaggattacattgataagttaaacagcctcaactttaaggaaatgtacgagaacgatttcttcctgacctgggagaaaacagacgaggaactggaagcagtatggaccgttgctgacgctctccgcttcatgagagagaacaacatttccacaaaggtatttgagagcggcctcggcatctccttattccgcgacaattccacccgtacacgtttctcctttgcttctgcctgcaacctgttaggtctggaagttcaggatttggacgaaggcaagagccaggttgctcacggcgagacagttcgtgagacagctaacatgatttccttcatggctgacgttatcggtatccgcgatgacatgtacatcggcaagggcaacgcttacatgcacgaagtagttgacgctgttacacagggccacaaggacggcatcctggagcagaagccaaccctggttaacttacagtgcgacatcgaccacccgacacagtgtatggctgatatgctgcacatcatccatgagttcggcggcgtagagaacttaaagggcaagaagttagccatgacatgggcttactctccttcctacggcaagcctctctccgttcctcaaggcgttgtgggcctgatgacacgtatgggtatggaagttgttctggctcatccggaaggctacgaaatcatgcctgaggttgaggaagttgccagaaagaacgctgaaaagaccggcggttccttccgtgtatcccatgacatggctgacgcattcaaggatgctgacatcgtatatccaaagagctgggctccatttgcagctatggaaaagagaaccaacctgtacgcagaaggcgattccgagggcatcaagactctggagaaagaactgctggctcagaacgcagagcacaaagactggtgctgtactgaggaactgatgaagaccaccaaagacggcaaggctctgtacctgcactgcttaccagctgacatcaacgatgtaagctgcaaggacggcgaggttgaggcaactgtatttgaccgctaccgtgatcctctgtacaaagaagcaagctacaagccatacgtaatcgctgccatgattatgctggctaagttcgctgacccggctgaggttttaaagaagctggaagaaaaaggaactcctagagtattcaaataaatcattcatcttaccaagcaatacaatgtaagggctgccggactgagtcctgcagccctttttgtctcaaattatgcaaaaactcggcgggataccctcatatcccgccctataaaggggaaaatcactatggaaaacaagaaaaaacgtattgtcatcgccctgggcggcaatgcactgggcaatacccttcctgagcagatgaaagctgtcaagatcacagccaaagccatcgtagatctcatcgaggaaggctgcgaggttatcgtagcccatggcaacggccctcaggtaggtatgatcaacaatgcaatggctgctttaagccgcgaagacgcaaaccagcccaacacccctctctccgtctgtgtggccatgagccaggcttatatcggctacgacctgcagaacgccttaagagaggaactctataaccgtgaaatgtatgatattccggttgcaaccatgattacacaggtccgtgtagatgcagacgatcctgcctttgaagctccttccaagccaatcggccacttcatgaccgaagaacaggctaagattgcagaagaaaagtacggatacatcatgaaggaggattccggacgtggctaccgccgcgtggtggcatctccaaagcctgctgaaatcgttgaaatcggcgccatccgctctctggtagactcaggccagctggtaatcgcctgcggcggcggcggtatcccggttacccgccagggaaaccacttaaagggtgcaagcgctgtaatcgacaaggacttcgcaagtgaactgttagcagagaatctgaacgctgatttcctgattattctcactgcagttgaaaaggttgctgttaacttcggaaagccggaagaaaagtggctggatgacctggacacagaagaagcaagacagtttatcaaagagggacattttgcccccggttccatgcttcccaaagttcaggctgctgttaaatttgctgaatcaaaaccaggacgcactgccctcattacgctgttggaaaaagcaaaagacggtatccagggaaaaaccggtactcatatccatttagcgtaaaggaggcaattaaaaaatgaatacagacaatacagtgaaacagcacgcatccctgtttgatttggatggtgtgccaaaaatgagccaggcaattcccctggcccttcagcatgtagtagccatgattgtaggctgtgtgacgccggccattattatttccggcgcagcaggcattgacacggcagaccgggttttgctgattcaggcttccctggtggtatctgccctggccaccctgcttcagctcttccccataggcaataagaacagtttccatctgggtgccggccttcctgttatcctgggcgtaagctttgcctacgttcccagcatgcaggcaatcgcggagcagtccggaattcccgccatactgggagcccagattgtaggcggcgtgtgcgccattatcgtaggccttaccatcaagaagatacgaaagttcttcccgcctctgattgcaggcactgttgtgtttaccattggtctgtctctctacccaactgccatcaactacatggcaggcggcgcgggccagcccacctacggtgcatggcagaactgggtggtagccatcttcactctggtggttgtcactgtgctgaaccattttgccaagggattcctgaaactggcatccattcttatgggtatgattgcaggctatatcttctccatgttcttcggcatggtaagctttggaaatgtggctgaatccggcatgttccagcttcctcaggtcatgcatttcggcatcagctttgaggcatctgcctgtgtggccctgggactgctgttcgttatcaactccgtgcaggcaatcggcgacttctctgccaccacggcaggaggcctggaccgcgagcccaccacaaacgagcttcacggcgctattttgggctacggcttttcaaacatcataggagccttcctgggatgtctgcccaccgccacctacagccagaacgtaggtatcgtggctaccaccaaggttgttaaccgcgtgacattagggctttccgcgctgattatactggttgccggactgtttcccaaattctccgcccttctgaccaccattccctatgcggtcttaggcggcgcgactgtatctgtattcgcttccattgccatgaccggtatgaaactggtcatgacggaagatatgaactaccgcaacacctctatcgtaggtcttgcagctgccctgggaatgggcgtgtcacaggcatccgcctccctgtccgcattcccgacatgggttaccacaatcttcggaaaatccccggttgtcatcgctaccctggtggctatcctgttgaatgtcacccttccgaaggataccggaaaagttaaaaagaattaatcctattattgtaatggtataactaaaaaacggaataactgaaaaacggactgtccctgagcatatcatatcgctcccgggcagtccgtttttcagttatgctttggataaaccatatggcttaacaacctccaaaagaaccatcctgattatccgtcagcagatgttcaaaatcctcctggggcatgggctttgcaaaaacatatccctggattacattacagcctgcttttcttaaaaattccacggtgtccatatcctccacgccctcagcgatggtctttatatccagctccttggccatattaatgacgttggacacaacaatgcgctcgcgcctgatgtcccggctcttttggaagaacaggatatccagtttcagcacatcaatgggcaggttctttaacaggttaagggaactgtaacccgaaccaaaatcatccagggaacagataaacccccgcgcattgagattgaccaccagctccgcaaataactccgtgtcagcagccagtatgctttccgtaaactccagctccataacgcggtccggtatggaatatttatccttgatatccgtatagtaatctacaaaatcattctggaacaggcctgccttggaaacattgaccgccaggctcaccggcctcccgccctgttccaggtgactcctgtaccaacggcatgcatgctcaaacatatagcggtccaatttcacaatcagttcgcttttctcaaataatgggatgaaattccccggcagtatcagccccctgcttgggctgagccaacgggccagcacctctgccccggtaatctggttaccgttctgaatatctatcttgggctgcatatagagcttaaactcatcatcttccatggctgcctctgcctcagactccagggcggtatcctccagcatgcgcctgcggatgctgtcgtcatagaacacataggagcttcccggtctttcctttgcaatcttatgggccatgttggcataattcaccagcacatccagagactgcttcccgtcaccggcccggaaccggtagacgcccacaggaatctccgtgaacggctgttcatccatgcccgaattcctcatatattccttaagctggcacagaccgctgtccagcacctgtgtatcctcacaccgtgttatgccggcaaaattgtcggccgctatgcggcagcagatacagtcaggtccttccactgtccttagaaactctgccaccagcctgagaagcctgtcgccttcttcgtaccccagaacatcattaatcagcttaaaattccttaaatcaccataccacagcacataggaagtaagctcagaacgggagatctcaggacggttaagaaatatctccacttcacgtttaaagcccgcaaaattacgcaggcctgtaagagaatcactgtaagccagttccatcagcatcttctgattattcacagccatcttccgctgtctgctcatcagccatataaacaggctgcaggcaaccacaatgataatcatgataccccatgctgtctggatgtagctggaacgcagcacatccacaggaaccatactcgcctggtaccattgcccctcgatgatgggaaggattaccagcatctgcctgactccctgtctgtccgtaagtatgaaatcccccctgccggtgtctcttatgacctctgcaatcttctccttattatcaggaagaatgtccccctcaaatgtcttaatggtcttaagcacataattgccgtttgcatccagaatattggaataaccggctcctttaagaaccggtgcgtcaatgatttccctcagtacgacagccgagtgaaccgcacagagaacgcccctggcattgccgtttccgtcattgattctgacgccaaaatagtttatatatccgctggcatcctgttggtctgcaaatgtgttggatatgcttttttcgccctgtaaagcccgctcaaaaaaatccatccctttcagattaacctcttccacattgccttccatatccaccatacgggcattaccgttaatatccgcgtaacccatacggataaaggcattttcctcatttatatcattcaatatggtcaggatctggttctcatccagaataaccagctccctgaggctaacagccagcccctccagcgtctgccagtctccctcaatttgttttaaaatggatgtccttgtctgattcgcagcatcatacaggtatgccacgttctctttctggcttttcaaaatcatttgtacaagaaaaataatactgctgccaataaaacataagcatagtatgataggaagcagcgtgtccctgcggctttttcctctgccatctgcagttgtcatctcatagtacccctgtcttctttagactctaaaataataataatatatttatacttaaatatcaatgacaaatatccccggaaacagtaccatatgctgttatttgatactgtttccggggtatacacacggcgttattcacttgttttccattgggtaagtttcatttaatctaatcattcagctcataagaaaccgttacctgggcttccacactgacctgtccgggcataacagaagcagccgcatcttccgcaaccgcagccgccatcttagcagaaccgcctgcattataggaagcatatctggtctccggctgatagccgaattcctccacatggaccacaccggccagcgtcttattgctggcctccgccagagcctgggcttttgcctgggccactgccatggctcccttcagcgcctcctgatagctggcatcatagctgctggaaaaatagctgacggaattaatctcgttgactcctgcggccactgactttgtgatgatggttcccgcattgtcaatcggtatgtcagagaccgtcaaactggtagtcatctcatatccggttatctcctgtttatctgaattccagttgcggataggactcaggccataagaagatgtctgtatggaagtttcctccactcccaggccctttaatgtctcaattgcagcgttcaggtcattggcgttcttctcctggcaggcagcagccgtatcctccctggtatagacggcatattcaatctgcgccatatccggcaccacctttacctcctcgcgcccggtcaccgtaatcacattctctgccgctcctacattctgtaccttcagcgtgtccggcatctgtgccccggccccgcatccgcccagccccaaggctgcagcggccactgccgcgctgatacctgctgtgtatactgtcttcttcataatatgtttcataattgcctccctcttttttgttttatcggaatctaatcatatgataccgggcacacgaatatgccctatccctatactaccagaaagagggaattctggtatttcttttctcttaattatagaggtacgtttcattacaaagtttatacgaatttatttccggcaatgcctggggtgccttcatatcttcagttccatatcttctgctccatatctttgctccatatctttgctccatatctttgttccatatgttgcctgctgatatttcaccgcggcccttgacagcggcaccggaaactgctaatatagagtgagcgcaggatttcgttagcataccaggtaagcgcagcactgaatattcaggggttgtactggtttcgacgggggtcatgcagctggtgaagctatccccatgcgatgggttaaatggcaaaaataaatataaacgctaacgacgaattagcaatcgctgcctaatggcagctgtcagacttagagcacccgcactttaagaccctggcatcgactatgtgggaaacgacgtatgcaaagctttgagcatatgggcgtatgatgaagctactgaaaccatccgggtgtcctttctctgatggcagagggaatgtcaaataaaggactatgatagtagaagaacagggaattgattttcggacaggggttcgattcccctcagctccactgaaaaagtcttgtatttacaaggctttttttgatgtttgggtgcctgtacccaaatagtacccaaatatcatgcttcacccattatttcatttattcctgtatctgaatcataaggattagtttggatatttccatttccttcaagccaagtgacgttataagtgccaagatcaaaatcatcaccagcggcataaagcccatatccaagttcgatctcattaagttcctggtttctaagtttgagttctgaaacacggccatcctcacaccctgctgagatttcctgtgtggaagtaacagtgagaattgttccgtcagttaatggaatattgtttaattcttctgtcccaaaattctctatcccaatatcaggactcacttgactttcataatcaaagatttcgtttatacttccatcatctgaaattagattcccacaaccctttttactaaaaaagctatatgtaccaactggaatgtctattccgacaatataatgaccctcagttaaagttgttgtaaaaacttctgtctcaatgggcgattcaaaattttcgggtacattatgaccctgaataggaatagtgacaatactatcaccattattacgatgagcaatataatacttaaatacaatacctattccagctagaataacaagcataaaaatcacaattagaattatatatttcttcttttgtaatgaaatcccactagaactaacctctttttgtcttatctttagattaggaaagttttcatgtataagctcaaccgtccttctaattttttcatcatttagtttgtccttatattcaaactgtgatattttaccagatgaatcaataaagttaatatatccactctgtcctggagcacaatattgatagtctattctttttaaatcctcatactctattgtgattttattaccccagaatgtgattatattacattcagttttacctatgtatagttcttttcgtgttccttttatactcaattcagagtctcccctctcggaataatatattaccataataacctatagaaagagaaagtaaatctgtagtttataggaacaacggtatattactaattcacttgtccttgataacacttccgacgctaccttgtttgcagataatttctatcttaggaaaacacacaataggtcagtcttttgtaaagacatattccacctaataatgaaattctacgttcgttcaaatgcattaccaaatctattctttatttttaactttagatattgaaccaaagactagccacaaggctaatccaagtgctaaattattaatcgcaagtccaaatacgattcctaaagccaatcctaatccccacttatcattagactcttttctcattataaattttcctccacataaaacatccctaagtaaaaatatttttgttcttaatttttattttatcatacagagacgaacttttatatgtatctttccttaaatttcatggattttcggactaatgattttataatactgtaaatacagatgtaatgattccagtcattatctggattttattaattcgtaggacggatgatacaggccagttggcccataaaactcatctccaatataagtaaaccctaatgcttcaagtactttttgtgaagctatattattaggattatgcccggcaaacagcctacaagcctttaaagtagtgaatgcatactctatgacggcgcttgctgcttcttttgcatacccctttccccaaaactccggtcgcaaatggaaacctatttcgtattccttttctgcatatggccttaaaccgcaacaaccaatcaaattatctgtagcaagctcaaagacaggccaatattgaacacggtgattcttctcatttaaaatttctgtattcaaacgttcctcaatatcatctttactaaatttcccagatgcgcaaatataccgtgttacttcggcattaccccataatacagttgcaagctcaagatcatcctgcccccattttgaaaaaccaatccgtttggttttcatgaaataaatatgtctctgcctcatcttaatcacctgctctgttgtattgatctcttttcgatcagttatttaacattagtaggaatcccttgtaaataaccatcaagatagttttgtgtcgcgctgtcaaaatacgggcaaagacgtgcaaaatcatcacaagcttgtttacaatttggattggtacaacggttccctccaaattcatagccacaactgcaatacatttctgatacttctgaaaattcttgacatatgggacattgttttaggcgttttaattcagacataataactccccctcggtatgttataggttcattgtagcactgtgcattagagattacaatgtaaatgagagcagttttaccattcacacacctcttacttttttgaaagtaacattatttacgtctgatacggtaattatactagctacgtataagtacaaataaactttttctataaagttttagcttcaatataccgatttaacaaggcatgaacttccccacagtaattaatagtgacgtcctctaaaatatcatcatctacaaaacactgtacagatgttcccaatgcttctaaataagccacatgataattcaacaggttttcaatataactatagtcaacgattccatcacacgcagcgagaagatgtgtccaaaacatccctactacataatcttctgtaggaagcacagttatttcaatatgatttctaaatccattctcattagaaagcaacgctaaatagattccttctgctttatcacgctcatattcccctatattcattatatctattatctctttaaacatttccatctgaagattatatggcatttttgatgccattagatatgcctcgtacaatttatatccagaaataattgtgtcaagtacatttatcttttctcttaaattagtagcctgaaataaatcatctaaacaagcatcaaatgtataataatcctctataaattcattccacttttcactaaataaggaaaccaactctccttcatacactttgcttacaaaaaagatattaccctgttttgttaacaatgctggaggaagaaaacttgatgtatatgcagatatttcgcttgcatgaagagttgttttattcttgaactcagcatatggataatcagaacaatcatactctatacaactatcacttattctcatcgtttcttttttattcatatcctattaccttcttccgaagctctgccgctgtagcatatacaaggttcctctgccactcagtcaaatcatcgtctcttctgttcaatatccggtatttatgtattccatgctctacctgtttataatatgcgtccagatccccctcaaagtcaccatcccatagttcagatacttttagccttgaatctccattgaccaatataagcgcatacccgaaaccgcttttttcatatatgcacttaacagcctgtacattttctgcatcaaacgccttgtgccactcaattagtatctcttcacgttcacgcaacatcatattaatctgctctgtagcatcctctaacagcttttcacattcctttaattgcatgtgctatacccccataaatctataacatcagcttcctcaaactcaaactattccaattcttttcatatctctctcaaagcactccactggtatgttgtccccttcatacccagccattttacaccgttccctatttacctcatgacaatgaaccgcctgaaataattcatcatcccttacctttacaggaatattccacaaataattgtccatctgattcaatccggataccgaacgccgaccatgtgttttagtaatctcaatatcatccgctttcttaaaatattcttcaatctccggttgtgtaaagccctccaataacatgccctgtcttaacccatccatgaatagagcattatagtccttccaggcagaggaatccataccacacataacaatagcaaacctgttatttgcatttactgcgaccagtgtttcctttgactgtaggataatcctatgtaaatcccaacagtaaaataaatcacataaagttccataaggaggctggtggactttaagaaatctctgtagaggtattgtaagccctaactgcatagcatcccactttctgttctaaaccatctctctttcaatatccaaaatctccgcttctgtacttccttctacaaactcccgtatctcctccataacactgtcggcctgggcattatgcgctactatagcagccacaccaataacaataatctggtgtatatcttgttccccaacctctgccacagatacattaaattcattccgcaacttagctattaagcttttcacaaccatgcgcttctctttgagtgaatgaacccatggagcatgaagtttgatacgcaatgatagtatagacattctttgcacctcgatataacagtatttttagaactatataggaattatagcatatccactaaataaaaagaactaccttccaatttagaaagcagtccttcttgtatccaatatatcattttccaagttttaatgactgcgcaaacattgccccatagtcaaacattttcatgcacaaatattctgtaattaattcataactatttataataacctctatgtccttatcctcttccccatccacccccaacctttggcataggcgctgataagcactcattatctctgtatatgcctgttcacacacttttccctctgaaaattcatcctctacaagcttacactcttcaggcggattatctttaaagtctaacgtaccattcatcaaatcataaattagtttcttgcgctcctccatagacttccatattatcctttcgtttgtctcacttttacaaccgattttactgcctaattagagtaaaatcaagtaaaagtgcaaaaaatgagacaaaggtacagttaagaggaagatatatggagaaactacgtcctaacaatggtggtaaaaacattattgctgaccagcttaaagcattacgtaatcaatgtggcctttcacagcgtgacctagcaggcaaattacaactagccggcttgaattttgataagaatataatcacaaggattgaaaccagtaaccgctttgtaaatgactttgaattaaaatcattgtctaactatttcggtgtatcctattcttatttgcttgatggaattccaacgtctgaagatttggaaaaatatcccgatttacttccattataaaaagtacgtggaaacttgacttgatgctccagacataaaagaaggaaccgaattcccatgttgggaaacctgttccttctataattaatgtagtggtctatatacgctcattcactctcatgcaataattcatccttatacttataaaatgtcattttggatatgcccagcagcttccatgtttcctctttgttaaggctaccgccaaatgttttattatactttttgattttctctttggcctctatggatttctttgtaacaaacgttgtaccacccttctgccccatctgctttccatttaacctagctgtttcaattccctctctagtcctctgacgtaaatcggatacttccttctcagcctggtcaaatgcaagctgtatctgtttcttggctaatcgcatgatatatttgttcagggcttcaataatactccgcataagctcatccgtagcaatatcaccactgtcaaaggcaatctgcaacttactttctatagccttacgatatgtgtccgtattaatatgtggctctttcaaaaacacaaggttgactcccttggtaaataattcctcatatagagaaaaaccttcctctgcattcctggacattctggaaaatgaatgaaatataatcgtatctcctgtttgattttctgagagtatcttatccagcccttttagtattacttttgacgctcattattactgttactataattataataccatactagaagggcatttcctttaatttgtcaacaggtccataatatcggtttctctcccagccgtttaacacttgaacaaaggctccatccgaaattgtatagatatggcagagctaaaatcacagagctaaaatagtaatcccacggtttatctaaatccgcgtttgcaatacaatcttttacagagcctatgaaatcctcataatctgcacaccaccacgaaacaatatactccccccacagcattctgcccaaccccggaatgtattgtccgtgagcaaatgtgaaacatgattatccaccaaaaaagtacacaaaataagctttcaactccagcaaagtttgtgcacactttttcgacaacaggtgatactataatagacgtaacccccccaatacattatatagtttttgctacaccccataaaaaacgaaataccttctcctaaaatggccagttccccgactggccattttactttgtttttttacattgtccaccgggcatactctaataaggcgtttcatcatccagcagctgaatccggagcacatctctgacctgagccggagatatctccaaaacttctccggtataagtgactgatacggtattccctgccctcaaatccttcagcgttatgggaacgcctctccatataagctctgttttatctcccactgccagttcaaaggtcccgcgtccattgatatcatttatctccaatccctgaaccagaaggcggttttcccttatctcctcgatgacagcataaaatgtggttccaaccagtggttggacgctccttcttcccccatagtagccgccggccgcggctaacagaacagccagtataatgcttacagtatgtacaatccgtttcatattccactccctttgcttcattcttattcatagaataacattacaggaagatttttttaataaataaactattaattattcttacgtattggcaaatactaaagactttataagacgttaatgctaaactggtaaataacatttatccgattcaaatatgatttattataaaggagacttccatgaacacatcagcaaaaagcgaacataccggaaactccggctttaaaaaggaggttctggagtgggtcaaaattctgttggccgctgctgccattgcctttgtcctcaatacctttgtcatcgccaacagctacattccttccggttccatggagaataccattatgacaggtgaccggatcatcggttccaggctttcatacgccttcggagcgcagcctcagaggggggatatcgtactctttgaccacaaagcggagccgggcaaggacaagacccggctggtaaagcgaatcataggacttccgggggaaaccgtggatatctgggataaccaaatatacatcaaccagtcggacactcccctggatgagccatatcttccggaacccatggactcagagaactatcatttccaggttccggaaggctgctatctcatgctgggtgacaacaggaatcattccagggatgcccgggactggtcagacccctttgttccggaagaagccataactgccaaggcattattccgctattttccaggaatacactggatttcctaacccttattactgatacagacaatgaaaaatacgttactgataaatattattaaccttccaggcccctccaaactgatacatggacaggccggaatcccctcccagctgcgctccggcatttccaactgcctgcagcccggatgcgtccgtggcagtaaccgaattacagagacggtccgtaaacagcctgccgccgcatttggaaatgaagctggcggcatcactatattccgctgatgtcccatcctcgtaaattacattcaccggataactgcaaatcctggaaagagtttcaatatctctgtacgaaaagcatttttggactgtagtggctgcttcttccaggtttccaattttgagggcccctgaatcactgccagcctggctgttgtaatcactgtatatgttgttgatcttccattttcctccaaatttaaacagactcaggcctgcatcgccgcccatctgtactcctgcattccccacttcctttaactttgaaacatctgtggatgcgatggcagacttcattccctctgtgaaaacgggaccggaccccagcgccagcagctctgacttgcttttaagttcagtcaattcgccggatgcatatgatatggtaagaggaaagctgcataaatccgccaatgcattcaggtcttgtttcttaaatgcggattttatcctggaagccgcgtccttgatttttttctgtccctcccgtctctgctttgcggaataagcagccgcgggttttttggatgcagcatacacaggcattgcgggaactgcgtttgcaagagccagtgtacagatggtaatgacagctaaatgttttttcatggtaaatctccttttcgtcttaattattttaagttccatacgggttcatacaattagacgggagagctttcataaaagttgcacatagtaaaaataagtttcagataaacaggtgaggtgtattcatggaaagagaaaagggcattgcatactgcgggcttgcctgctgtgtgtgcagcgaaaatgttctttgtcctggctgccgcagcggcggctgcccgggcagagaaacctgcaaaccgtttaactgctgcataaaaaacagatgggaaggatgctgggaatgtcctcagttcccctgcggtgctgccatcttgcaaaaaaccaggattcaggtatttgcagattttgctaaggaatatggcatggactccctgatggatgccctggagaaaaaccaatgccgcggtgttgtatatcattatcccaatttgctgatgggagattatgatagtttgagcagcaaacaggaaattctgcatctcctgctgaatggaccgcaagaccgtataaaaggcggcatttttatgcaatcattcataccgtggcttgaccgtataatggccggccccctgccggaggaaatcattgccgtcaactttaatctctatgatgacggagacagctgctggtccatggagttcatcggaacccgcagctttgacgcggatgacccggactgggcctgtgacgaagtatttatttcccgtgacagcactctccactgggtacaaaataccggctggcagcaggtgctggaggatacggtacatacaatacgtgcttatctggcaaatggaacatacgccggcaggctaaaggcgtatcagggaatcggcacagggtttgttgatggggatatcgtcattctgtatgaaactcccaaagaatagcaaagaacaggctggcaatacgcgtatataaaacaaacagcatttcgtgccgtatcggcccaaaatgctgtttgtctatgtttatctatgcccggttgtgtccgttcgtattatgctgcgccagacagctctgcacaccttttggatagaaattccggcaggttcccggcagagtcagattaaggttctgccttccacaaaccatgcaggttgcaatatgcgtatgcagcctctgcctcatctccttcacagagcataaactctgcctgcggcttctgtcccggctgcagctcttttctctgatttccctgtctggtagccagagcaatccactggatatagtgttccggaatcatggggtgctcggctgagcctactgtgactgtgaccttagacccatctatctgaatgacaggcacatgcttttcaactgctgcatctgtggtgtttggaaccagttcctgcatcttttccccacaacagacaaccgggacaccgctgcttttcacataggcaattatgttgccgcagtgattacaaatataaaatttcatgttgtacctccttttttatgtatggtctgaatccagtctaccacaattctgtcttattgcaagacaatggaggaaaattaacaatagcataacagctataacggccgtaatcaggccctaatcagcatgatgcttagtcctgcctgtctattcacaaacttctcacattctgttcataaatccgttacagaatcataaaattctcctcacattttatggatatactaatttatgtaaagagctaatgctaataaaactttttttcataatactcggccggagggatgtaatccttccggcctcctccttttccttcaactttctggattctttttactatcccggcatatgataattaaaaaaggatatttttttatgaactatgaaaatctgactcccgtggtcggggtcattaccaacatttccacgcaggatggggattgctgcacccaggttataactctcagtgttgagggccagcccgtcaacatgattctctccgacgacacctttgtggtagataccatgcgcctgatgccaggtatgcgtgtggctgctttctatgataacaccctaccggtccccctcatctacccgcctcaataccaggccgatttaatcgccgtagtcaggccggaggaggatgtaaacctttcctggtttgatgagactctcactgcttctgaccaatccctgaagctgaacctgtatcagtccacagttttgtcaaccttaaacggccagccctatttctgtttcccggcaaatcatttcctgctggtatattatgcggctgccacaaagagcataccgccacagacagctcctaaccgggtcatagtgctgtgttcatagacctgtaaggaattattttttttcattttcacaagaccgttgtaagaatgcataaaatagtttttttcattctgcaaactttgtgcacactttttggatagtgtatgctattataattaacgtaaacccccccaatacattatatagtttttgttacaccccataagaaacgaaataccttctcctaaaatgaccagttccccgactggtcattttactttgctcttttattggttccatatttttgcaaatatcgtaaaaatattttttccgtttttttattaaaagtactggacaaactaaattttatatgatattatgtataagctgtcgctgagatgtacagataaggcctgatggtcaagcggctaagacgacgccctctcacggcgtaaacccgggttcgattcccggtcaggtcatgaaaacaagcagacaaaactgcttgttttttattttttcggactccaaactattgtaaaattaagtaaatacatttttaaattacattttttcaaaaaatactggacaaacaaaaaactttatggtattataaacaagctgtcgctgagatatacagacaaggcctgatggtcaagcggctaagacgacgccctctcacggcgtaaacccgggttcgattcccggtcaggtcatgaaaaaagcaagcagatgaaactgcttgcttttttgttgttctattcctcaccgtttcttccacatcattttatttccatgcgcgtccttgtttctgcatcaatcaggctgcgcagggcttccagccgttcatcctgctcaaagtattcctttccgtattccagattaaatccatagtcaaacccgtcaggatttcttccctggctgtgctggataatggtttccgccttatccagggcttttacaaatctggcttccggggtaatgccctggctgtattcctcccacagccctgacacctccccttcctctccttttggcaaaaaaacgcatatccgctgtacatcttccctttcctggttcagtttatcaccggcatccggccgcaatgctgccgatatgtctccgctgtaccgttcccccaggtcgtgaacaaggcacatcatcagtactttctccctgtccagttccggaaattccctgcacatcaccccggcaaacagagccaggcgccaggagtgctccgcagtgctctcctgccgtccctcagcagtccaggcagtgcgcagagtggacttaaggccctcagcctcctttatgaaatctgtgtatgcttccacttcactccccttgttactgccaatcctcataatatcctctcgttcctatccctaatacagattttttaccttaaattccttttccagttcccttctctggtccttcttggcaatgtctgcccgcttgtcgtagagcttcttaccacgggccaggcccacctctaccttcaccagactgcctttaaaataaacctggagaggcaccagggtatagcccttctccgcaatcttgccgttcagcttcatgatttcgtatttatgcagcaaaagccttctgacacgcagaggatctttattgaatatatttcccttctcataggggctgatgtgcataccgcacacatacacctcacctctgtcaatcttcacaaaggcttccttaacgctgcattttcccatgcgaatggattttacctctgtgccaaagagctcgatgcccgcctcgtatttctcatcaataaaataatcatggtatgccttcttattgttcgcaaccagtttaatactttccttccccatggtgtttccctttctttccagtcatgattgcatgtatgacttacagccttacacggaagctcccttacccgcgctcctgtcccagtctcggggcaggataaaatccactgtcctaagcagacggtccgtggacgccacctgaacccgtatgggctggcccagcttaaatgttttcctggtcatctctcccaccagttcgtaatgctgttcatcaaatatataataatcatccctcagctcgcttatgcggaccagtccttccaccgtgttaggaagctccacatacagcccccagttggtgacgcctgatattacgccgtcaaactcctgcccgataaatctggacatatactcacactttttaagcttgtccgtctcacgctccgcttcctctgcacggcgctccagagccgatgtctgcatggcgaccccaggcagtatggcttcgtaatggccggccctcttttctcccagtccgcccttcagactttcctttatgatacggtgaatctggaggtccggatatcttcggatgggcgaagtaaaatgtgtgtaatacctggcagccaggccaaaatggccggagcacagggtggtgtactttgcctgtttcatggagcgcagggtcagcctggaaagaagcacctcctcaggcgttccctctatcttatccagaagcttttgtaattccttgggatgaatctccccctgctgaagccggatgaaatatccaaaattatggataaaggttcccagctgcttcatcttctccggatccggattgtcatgggttctgtagaggaagggcagggattgccagaagtaatcctccgccacggtctcattggctgccagcatgaaatcctctatgatttttgtggcagcattgcgctcataaggtttgatctccaggggctttccctgggcatccaggataatcttgctctccgggaagtcaaagtcaatggctccccgtttcttccgcttttccctgagtatgtcagatacctctttcatcagcatgaacatgggcacaaacccctcatactcagccatgacagcttcgtctccgtccgtgacaatggcattcaccgccgtgtatgtcattcgacggtccacatgaatcactgtctccgcgattttgtgacccagcacgtttccctgggcatccagttccatgatgcagcttaaggccaggcggtctgtgcctgcgttaagggaacagattccattggacagcttatggggcagcatgggaatcaccctgtccaccagataaacgctggtgccccgctttaatgcctccttgtccaacggacggccttcttttacataatggctcacatccgcaatgtgaactcccaggatatagccgccctgtccgtccctgcacagggttaccgcatcgtccaggtccttggcgtcctcgccgtcaatggtgaccgtgcgcagtccccgtaaatccagacggccggccaaatcaccggtccagtctgccggcgatgtcaaatcaccaatgccgtaaggtccgtcccaggtttcctcatcccttccagggccaggcacagccacttcatccggacacccttccacctcgtccatgacctcaggcggaaattcctccggcagtccataggctcttacaatggacagtatgtctgttcccggatcattgacatggcccagaatctcagtcactacaccctccggcttatggttcgcgtctccaaactccttaatccgcgccaccaccttatgcccggtgacagcacccatatcgcagccctggggaatgaaaatatccttggaaatcttctggttatccggaatcacaaacccgaagcccttgcttttctggtaatacccaaccacctctttgttggcatgttccagcactttaagcaccgagccttcagccctccggccgcctcccctgtcctgggattccaccacaatctggaccctgtctccgtgaagggccgctcctgtcctgtcctcagggataaacacatcctgctccatgccttccacggtcacaaaaccaaagcccttgggatgtccgcaaaaaataccgttgacagaaaaaacttccggtttcccatattttcccttcttggaaattccgattctgccctcagataccagatagtccaatacctgtgtcagttcatctctctgtgattttggaatgcctaaaagcatggccagttcctttgccttcatgggcacgtaggacttgtcgttcatcacctcttccagcatctttgccttctgttccaatatttctttttccatataacctctttcttataaatgtcctgcctgtccgaaaacaggtcaaaacccgcctgaatgaaataaaacacccttatatgaatacaagggtgttttcgtcacttatccttctgttatcttaattaccccatgaccttaagtatcacgttcagggcaatggtaatgagcatgaatgcaatggctccatacctggtaaagtgctccagcgcaccttccatggaacggcctctgttcttactccagtaactgtctgtggagattccgccaattgcgctccccagtccgttggacttaccttcctgcatcaggataaccactgatattgcaacaccaagaattacatatatgattgacaaaataacatgtattactgacatccgcctgcacctctccattttcttatagtcaaacaaaaaatattttaccatactttgtcctaaaacacaacctgttttcctatatttttataggtaagacattgcaggagcttcattcaggcatcgcatttaaaccgcctgggaacaaatcatggaaaggctgccctcaaagataacatccccgaatccggcaggcacaataaaatgctgtccctttgataccgggatgccgtttacacttccctctccgtccagaatactcacattggcaaagctgtccccataattctccgtccagcagcctgtcatgtctatcttgtccacagtatagtaagcacaggtcacaagatgttcttttctaccgctgtccgtctccttcacaactgccggcattgcattttggtcctccttaaaaggcgcttctatcacatcaatgctctcctttatatggagctgcctgggcttcccgccggacagcctgtcgtagtcataaacgcggtatgtaatatcactgctctgctgagtctccaacaccagggtgccgccctttatggcatggacgcatccgggattaatctggaaaaagtctcccttactgacaggaatttcccgtatgaaatccttccagcgtttttcctctatcatctgctttacttcatccttattacctgcatggtgcccaatcacaatggtggcatccggatcgcagtccaggatataccagcattctgtcttgcccagagatccgttttcatgctccccggcgtaggcattatccggatgaacctgtatgcttaagtcgttcctggcatcaataatctttaccagcaatggaaattccttatgacagcctgccgcagccccaaaccactcagggtggctctcccacagggagcttaagctctgtcctttccatgttccgcctgcaatacggcaatccccgttcttatgcgcgctgatggcccagcactcacctgtgcggctgcttgggatatcgtaaccaaacacatctttaagacgtgttcctccccagatggcctccttgaaaacaggttccataaatagtaattctctcatgtctctctccttatttttcccctttttaatgcaataatgcatcttcttacatcataccctgctttttccggttgtcaagatttaaatgggacggggaaaggattttccggacgaattaccgcccggaagcatcccctttcccatcttttgcaccgtatctcccgcactgcatctcccgcaccgtatctcccgcactgcatctcccgcactgcatctcctgcactgcatctcctgcactgtatctcccgcactgcatctcctgcactgcatctcctacgctgcatctcctgtcattgcaggtccctgtgaagtgcgaagacagcataaatgcgttttccaatcgccttttaaccttccaggttttcctcaatacgcagcagctgattgtatttggccacgcggtcagaacggcagggagcgccggtcttaatttgtcctgcattgacagccactgcaatatccgcaatgatggaatcctccgtctcaccggaacggtgggatataatggtgccgaatccggccctcttagccatttcgatagcctcaaagctttcagacagcgtacctatctgattcaccttcaccagaatggcgtttcctgctcccagctcaatgccctttgacagccgtttcgtattggtgacgaataaatcatctcctaccagctgaatacgtcctcccagttccttggtcagcattttccagccctcccagtcctcttcctggagtccgtcctctatggaacagatgggaaacgcatccacaagacggcggtagtaatccaccatctcctgtgcactgcgccggatttcctttcccgccatacggctttctcccggaaacaggtacatgccgctggcttcgtcgtaaagctcactggacgcagcgtcaatggcaatcttcatatcggcacccggcttcaggccgctcttttccatggctctcaccagaaattcaagcacggcctcagagtccttaaggtccggcgcaaatccgccctcatcccctactcctgtgctgtagccttcttctttaagaagcttctttaatgtgtgatagacctccgcgcacatcctcagacgctccgcaaaacagcaggccccgaacggcataatcatgaattcctgcaaatccactgtattgtccgcgtgttttcctccgtttagaatgttcatcatgggaatgggaagatcagatgcatggattcctcccagatacctgtaaagaggcatcctaagcccattggcggcagccctggccacggccatggacacgcccagaatggcattggcccccagctttcccttattctctgttccgtccgcctccataagcagacggtcgatgtgcctctggtccaatgcgctttcaaagagaaccgcctcactgagaacagtattcacatgttccacagctccccggactcccagtccgttgtaccgattcccgccgtcccgaagttccacggcctcgaattttccggtggatgcaccggagggaacagccgccctgcctgtggcgcctcctgtcaggcacacctccacctccaccgtaggattccctctggaatccagtatctctctgcctgttaccgcctctatctccagttcgtttaccataaaaaaatgacctcctcatatcaatcttatcattgatataaggatagccattttttaacattatatgtatggaaatcagtcatttcagcaggcttatccatttctaatttatcctggccccgtctgctcccacggtaaatccatccggtgtgaccgcagataccagcatggctcccgacggatcacagtaatacagcttatccccccaggatatccagccggtcttcatatatccctcctggtcaaagaaataccacttgtagttgatatactgccagccgtttgacgtgtaagttccgtctcccttctggtaccaccagccccggtcatctctgagccactggccgttcaccctggtcagatcttcctctgtaatctcaatatagggggattcctgccattcacctgcattgttcctggaatccatggccctgactttaaaatagtaggtgcctgcctttggaaacttgccggaaaaatcatagctgttttcctttaccgtataggtggctccgatgccgtcctcataggaattgcctcccctgcggcacagtcggaccttataattctttgccaggctcatatcgtcccagtgggccaccccgttatcttcatcccacatcaaaccgcttacatccagatcctcgtcatcctcgtccagcttatccagccttaccaccaggaccatctcttccttatcattcttagtggaactggatacatacttgaccgtatcgccggaaaatgaaaacgcgctctttcccgatttcttaaaataataatcactgtcagcggaaagccatatctccactttgggtttatccccgcctacccagttgtcaccctcattgacaatatccacgctctcaatggaacactccccatcctccaggctcacgtccacgtttccgcctatttctcctgcctggatatccgatgtgaaattcaatttaattttccccaccggtgtcctttcctcttttgcaaaggatgtaaaggacagggtgcaggccataaacagagccgcacctgccagcgcggcatatgctcctcttttcctcatttgaacctcctccttcccgcttgcgtctgttttcctattatagcacatatcaccggcttctgtcatcctccggcacaccaaacttgttccattttcatatagtatagtatgccggggagttaatggacatccggcctataatgaaacagatatacagggggattgcttttgataaccattagtctttgtatgattgtaaaaaatgaggaggctgttctggaacggctcctaaggaccatgtccactgtggcggatcagattgtaattatggataccggctccacggaccggacaaaagaaatcgcagcccgctatacggatgaggtctacgatttcccatggacggatgattttgccgctgccaggaatgccgcctgccagaaggcggtatcggactactggatgtggatggacgcggacgatgtaatggagcctgaacaggctgcccgcctaaagaaattgaaggaaaccctggacccctctgtggatgtggtgatgatgaaatatctcactggttttgacgaaaacgggagaacctccttttcctattacagggagcgtatcttaaaaaaccacaaggggttccggtggcagggccgggtgcatgaagctgtcccccctgccggcaatatcctatacaccgatattgagattcagcaccggaaggagggcgccggggataaggaccgcaaccttcggatatacgaaaccatgctgagccagggagaaccactggaacccagacaccaattctactatgccagggagctctattaccatgaacgctatgaagatgcggtacgggtgttcagggcattcctgcaggaaccggatggatgggtggaaaacaagatagacgcctgcctccatctggctctgtgccaggagcatctgggacatacggaaaaggccgtggaggcacttttaaaaagcttcttatatgacagcccccgcggtgaagcctgctgtgaactgggacggatgaaaatgaaggaggaaaaatacagggaggctgcttattggtatacccaggcattatcctcccggcccgcagaacagacaggcgcttttgtccgaaaggactgttacggcttcctgcctgctattcagctgtgtgtatgctatgaccgtctgggcgaccaccgaagagcatggcattatcacttgaagtcacaaaagctgaaacctgaacacccatctgtcaggcagaaccagacctactttgaacacatactgaaacgtccggcggaagggcagccttccgcacaataaaataaggagaggtaattatgtattttaattttcccaacggaatgaatcgaaatgataatatagaacaacgcagaccatgcggataccccggaaataacggttttccaggtaatggcggctgccacggcgactatggtttcccaggttccggaagatacccggaagatgattgcccggacagcgacggctgtggcagcgacagcacagcccagacagataacagatgcccaggtaacggcgggtttccaggcggcaatccaggcggcaattttccaggcggcgggttcccgggctgctgcccaggacccagaggaccacaggggccagccggaccaacaggcgctcaggggccaatgggacccagaggatgccccggagcacagggtcctaccggaccaactggtgccatggggcctcagggctatgtaggccccaccgggccgaccgggccaatgggacccagaggattcaccggtgagacagggcctcagggaccccagggaccaatgggacttcccggaccacagggcatagccggcaacactggcgccaccggaagccagggaccacaggggcctcagggagttaccggacctgccggacctcagggcatccagggaccacagggagctaccggacctgccggacctcaagggccacagggacctcaggggccacagggacctcagggcagcaccggagccgcagggcctcagggactgaccggagctaccggccccatcggcccgaccgggccaacaggacctcagggcatccagggcatccaggggccccaaggacctcagggagccaccggcgttaccgggcctcagggtatcgcaggagtaaccggaccaaccggagtaaccgggcccaccggagctaccggggcaaccggcgccaccggcgcaactggagcaaccgggccaactggcataaccgggccggccggaaccgcaggggcaaccggcgccaccggcttagccgggaccaccggaccaactggtgccaccggacccaccataataagaaaacggctatatatccattgtatcaggaaaaataaaataagagcttatcactttaccggacaagcgccgcccaagtagagactacgggcggcgttttccgttgtgaggcggaaaggaggacaattcccatgcttcgggccaacatggcccgaggccgcttctgggcctgactgaaaaagttaggccctttttttatgccaaaatgaaggaggttaattgaatggctgatgataaaaaagatttgaagcaggaggaaccgaccaagagcggccccgccgctcccgaacagaagccccccggcaaggacgcaccgcccaccaaagaagccgcaggttcacccccggtaaaggaggccccggcccctgaaaaggacagcggcccgaaacaggaaaagacggacgcggcaggccccgcggataaaagccgccccggaaacgtcattgatatttccggcgctatgattgataaaatcgttgcggagaaagaaaagacggcaaaggtggcggaggccgggaagggacaacccgccgagcctgaaaaaacggaacagaaggataagaaagagccggagaagcaggcgggccgcgctccgaaagcggtaaaaaaggcccctgaaaaatcggataagccgcccgccgcccaaaaggccgagccgaaaaaggaggctccgatccccgagaagccgaaggagccggaaaagcccgccgggcctgtggcggccccgcgttccggggagccggaacagattgtccacatcaacctgtccgaactccacgccttcaaaaaccacccatttcaggtgcgtgatgatgaagaaatgcgggcgatggttgccagtgttaaggataagggcgtaacacagcccgccattgtgcggccccgcgagggcggcggctatgaaatcgtgtccggccaccgccgccagaaggcaagccggcttgccggatatttggatatgccctgtatcgtccgcaaccttaccgacgaacaggccatcacgcagatggtggaggacaataccaaccagcgtgaaaatatccttcccagtgagcgggcgaaggccctgaaaatgcagttggaggccatcaaacatcagggagcgcgggagacttcgggccaaattgacccgaaggaggccggaaaacgctccaatgagattgtggccctccgcaacaaaatgacggtgaaacaggttcagcggtatattaagctcaacgaccttgtgccggaactctcaaaggtcatggacgagggccggataaaattcactcccgctgtggagcttgcctatatcgcaccgaaaaatcagcagtatatcgccgttgccattgacgcgcagcagtcggccccgtctctctcgcaggcacaacgtatgcgggagctcgaccaaaaaggcgtgctcaacggtgatgtgattgatggaattatgctggaagaaaagaaggaggtagacaaagtgattatcaacggtgcagagctggaaaagtatttcgggaaggaaaagaccccgcaggaaatgaaggagcagatcatcaaactgctggacgattggaagggcaagcagaaggaacacgcgaaacccgagaaaaaggcggagaaggagaaataagacagggcttcgggccaagttgccccgaggttcctgcctaaatgcggggctctgccccgcgccccgaggctcaaaggatataatatattccccgtcgccgtggtctgtatagcgcaaccggggaaggcagtcaagggtggcgcttgcgccaccgcctgcggcggcgaagcccttgacagcctttcccggttgtgcttgtagtagtcaagcgacggggatatatattcctttgagccgttccccttcccacgggaaggggcggaggggatgggctatctattaagcgcaaacaggaaggaggaaccccatgaaacgacctttagcatacatcaccgccgcgtggacaggcgaacacaaggccgacacggaacaggcggcgcagtattgcagggcggtctatgaggccggattttccccggtctgccctctggtctacctgcatttgttcctgaatgacgatattcccgaggaacacaaaagcgggattgacatgtcccgtgatatgctccgccgggctcatgttctggtggtgtgcggcaacggtatgacagaagatgtgaagaacgatattgccgttgccgggcggctcaacatcacagcaaccaccctggacggcatactgaccgtgaaaggcaagggccgggaggctcggtgcgatgattagcgcctatattggcaatctcggcaaatacaatgaggggattctcgcggtggaaccgttgagatttcccgcctcaacagaggaagtacaggccgtactttccaagattggcgtggacggtatacggtatgaggaaatctttattgccgattttgaaactaatgttgccgggctgcggaaccatttgggagaaggcgaaagtattgacgaactgaattatcttgcctccctactggacgaactggacaacggccagaaggcaaaatatgaagccgccctctcgctcggagaatataccgggagcgttaaggatttaatcaacctgacccaaaaccttgactgctacgaattttacccagaggtacagaatgaggaagaattggggcggtatctcattgacgagtgcggagcccttgacgtgccagaacatatcaaagactattttgactatgaggcatacggaagggatatgttcttaaatacgacaagcgattttgcggggggcggctatatcgagaacaacgggagtcccttcatggaacactatgacgggaaggttccagaggaataccagatattttcctatcccgatgaaccccgccgctccattctcgaagcattgaaacaattccgggaggccccgcccccggaacatggcaaaacagcaaaggccgcgatccatgaggaacggtagacctcgggccaacttgacccgagtttttttgctggccggacgaaaggaggtgtgaatattgccaaaaaagaaagcgcccgccgtggaaacgccgattgctgaaaacgagtatgtgaaggaactgctggccctgctgaaagaaaaccaatctccggcaggaaaggaactgttagaggctatcggccatgtttccgaaatggaaaaacagcttgccagcgcggttgacgagctgaaagccatgcggcaggatttggagaaaatgaagaaccacccgttaaaatcagccctgcaaaaatcaatcgttgtcctgcaagaccgtattcttgccctgcgtgacagtctcgcggagttgaaagccggtatcattgaaggctgtaaaaacacattgaccgctgtgaaggagcgtggaatttccgcgctggatcacgccgcccggttcttccatatcaagccggggctgacagccctgcgaaacaacatcaacgaaggcatacaggcggacgagaaggccatttccagaatagaggccgtaagcgccgagtaccacgaagccgggcggcatgtgaaaaacataggccgggccctgatggggaaggaggccgtacaggaggcgaaggctcccggcaagctggcaaagacggtacaggccccctaccgggcggaacgggcctgtttccttgcggcccggaacagtctggataaggcggttgccagtcttgaacggctggaacgtgccgccgaaagacagccttctatcttgaaaaccatgcaggagcacaagacagcaaacccgccgaagaaggaaaagacagctccggcggcggcacatgacgggcggtagacctcgggggcctccggttttaactggcggctcccggacaggaaggaggtatcaatggaagaagaagtatcaagaaaaaccgtagctatatccgtacaggcggcaaagctgacgggccgggtgctgttcatggcgtgccagaagtttctggccggaatgcagaaacacaaccgggacgcgctcacgccccacgggcggcagaccgtgaaacagctcatgggccacaccggacagtccaacagtatccagctaaagggagacgcccgcctgtttgaccgggtggcccggaaattcaatgtagactatgcgttccataaagtaggcccaaaggactatctcctgtttttcaaggcgggacaggccgacgccatcacggcggcattttccgagtataccaagcgggtgatggcccgccagaacgacaagccctctatccggcgcgggctccagcaggctatgggccgcgtcaagccccggcagaaggaacgggaaaagaccagagaggcggtgcaggaacggtgaacgccaaaatcaaaaaatatgtggttcccaacctcccgtacctgttcattttctggttcttctgcaaggtggggacggcctaccgcctcgcggaaggtgcggacttcggcgcgaagctcataggtatgatgaaaaccataggcccggctttcgggacaatcacgccggacctcgctggcttcgatttgctggtgggccttgtgggggccttggtgctccggctggtggtctataacaaagtgaagaacgcaaagaaattcaggaaggacgtggaatacggctcggcccgttggggaacggccaaagacatagccccattcgtagacccgaagtttgaaaacaacgtgatactgaccgggacggaatttttgactatgaacacccggcccaaaatcccggccaacgcccgaaatctcaactgctgtattatcggttcgtccggctcgggaaagacccggttctggctgaccccgcagctccttcaagctcattcctcgtatgtgtgcgtagatccgaaaggcggtgtcctctcccaagtgggccatttcctgcaaaagaggaagggttataaaattaaggtgttcaactcggtggacttccgaaagagtatgcactataacccgatggcctacatcaagacagagagcgacgttctgaaattcgtaaacgccctgataaccaacacaaagggacaagggaaagagggggacgagttctggacgaaggccgagacgcttttgtactgcgcccttgtggcctatatcgtatttgaggggccggaggaagaacggaacatgaacacgttagttgaaatgattaacagcatggaagtaagggaggatgatgaaagtttcaagaacgccgttgattatatgtttgacggcctcgccaagcgcaagccccgatgcttcgcggtgcgccaatatgccaagtaccgcctttccagcggcaagactgcgaaaagtatcttgattagctgtggggcgcgtctggccccattcgatattgcggagctccgggagattatgagctatgacgagttagagcttgacaggctcggggacgagaaaacggccctgttcttctgcatttccgacacggacagcacctacaactttatcgtggcgctggccttctcgcagatgtttaacctcttgtgtgaaaaggccgataacgtctacggcgggcggctcccccatcatgtacgggtgctgtgggacgaagccgccaacacgggacaggtgccgcagcttgaaaaaatggtcgctgtcattcgctcccgggaaatcagcctgtgcctgttctatcaggccatgagccagtgcaaggccctgtataaagacaattccgaaaccatcttaggaaacatggattcggttatcttcctcgggggccgggagcactccacgattaaggaaatctcggaggtactgggaaaagagacaatctccatgtataccgagagccggacacggggccagtcggaaagctacggccagaacctccagcggctcggcaaagagctgatgacaatggacgagctcaccacaatggacgggagcaaatgtatcttacagcttcgggggctccggcccttcctgtccccaaagtacgatttgaaaaagcacccgaactataaatacacggcggagacagacaagaagcgcaacgccttccgtctggaaaagctgataagcgcccggttgaaactgaaccccgaagaagtctacgaggtttacggggccggggccggggaaagcgccgaggacgatattctaaattatgacgatctggacgacccggacgccttcgcttgacctcgggccaagttggcccgaagctcccgccgcctgaaatgggcggcttttttcgtagccggggcgtttgccccacaacaacaaacattttgaatggaggaaactatatggaattttttgcttctgctatcgacaccctgaaaatccttgtaatcgctatcggcgcgggcctcggggtctggggcgtggtcaatcttttggaaggttacggttcggacaacccgggagccaagagccagggaattaaacagcttatgagcggcggcgggattatcctgattggaacaacgctcattcccctgctgtccggcctgttcagctaaacgataaggagacgccatgcagataatcttcgacgcaatcgcggaatggctcaagggcctgctggttgccggtatcatgggcaacctcggcgggctctttgacaacgtaaacgcgcaggtcggagagattgcagaccaagtggggacggccccggcggcatggaacgccggggttttctccatgatacggcagctctccgagactgtcattctcccaatcgccgggctggtgctcacctttgtcatgtgctacgagctcattcagctacttgttgagcggaacaacctgcacgacatagacacatggatatttttcaagtggatattcaagaccttctgcgccattctcattctgtccaataccttcaatatcgtgatgggcgtgtttgatatggcgcagtccgtagtccagcagtcggcgggactgatacaggggagcaccgaaatcaccccggatatgctggccgatatggagacgcagttggaggcgatggagctgggccccctgctcgggctctggctccaatccttctttgtgggctttaccatgaccgctctcaatatcgtgatttttgtcattgtctacgggagaataattgaaatttacctaatgacgagccttgccccgattccccttgcaacggtagtcaaccgggagatcgggagcatgggccagaactatttccgctccctgctggcggtgggcttccaagggcttttgattatcgtctgtgtcgcgatctatgcggtgctgatacaggggattgccacgggcggggacatgataggcgcgatatggggctgtgtgggctataccgtcctgctctgctttacgctctttaagacgggctccctcgcaaaatccatcttcggcgctcattgataaggcggagcttcgggccaagttggcccgaggtttcagaaacgaggtgaggctatggccccgagacggtacggagtagccccggacgggagtattcagccgctatggcatggaaaactggcggaggattttaccgaggcggacaccctgcgcttcatggccgacacggatattcagttaagcggaaacgtgtctgcggacacgctgacggcaatcaggcgggcaggctaccgctacgagggcggggaggttcttcccctgcccggaaaggaggaaatgacaatgagcgaagaaaagaccacgggcgcgcaggccccggaacaggaggcccccggcggctccggcttaaagctggacgtgaccgcccggcccattgaccccatcaaaaatctggtgggctttgccaccgtgaagctcaacgactgctttgtggtggaggacttcaagattttacagagtgacaagggcttgtatgtgggtatgccgagcaagccggataagagcagccggacaggctaccgggacacggtgaagcccatcacgaaggagttccgggaggaacttcacggggcgattttagaggcgtaccaacaggagatagaaaagttgcaggcccggattgccgccgcccggcaggctccacccccggaaaaggcttccatcaagggccagttggaggccagaacgaagaaggcggcaaaggagaacgccgcccgagccccaaaggagaagccagcgaaggcggcggagcggtaacgcttcgggccaagttggcccgaggttccccggcggaaaggaggcgttttcattggcaagaaaaaaatccgggtatggcgcggcctgctactatgccgggaagatggtgggccgctgtacggtggcggacggtgaagcctatactgctctgatggaacaatgcggcggaaacgcggcccgcgttttacgggagtatgcctatttctcccccgaactgaaagcaattttagagaatgtggcggttatgcaggccgcaaaaagccgtgctgaaaatccacctggcctgttcgcggaaccgaaaatctccccgtggggaaaggtgcagacctgcgacacgctctgtccgggcgtctttctggtgagtaccgccagccacggcgggacaatggtttcaaaggaagtggcggcatttctctcccccgccgctaaaaaatgcggtttccggcagggcggctatctctgcttcgaggaagatacacaggaggaagtggttttccgggaactgctggataagcagctctggaaaatccccgaccggattaggaataaggaggcgtttgaagaaaccatcaaccaatccctccgggaacacaaccccgcatattggagggcgcggaagcgcgggagggaaaacgcccggcccgctgtccggcaggacgcggcccggagtgagacacgataaccgcttcgggccaagttggcccgaggtgatgaaaggaggttttgagctttgccctatgtgcaggttccaaaagatttatcaaaagtaaagaccaagctggccttcaacctgacaaagcgccagcttatttgtttctcgggcgcggcggcggtgggaatccccgtctatctgctgacccgccccgtgattggcagcagccccgcgctgttcctgatgattggcctcatgctcccattctttttctttgccatgtttgagcgtgacggcctcccctttgaaaagatactgcgaaactatatccgggcccggttcctctggccccaagtccggccctacaagaccgaaaatttttatgccgcatggagcggccccggcgcttcgggccaagttggcccgaggccggaggacacaccgaaaggaggtaccaggattgcgaaaaggaaaagaggtaaaacaggccgcgcccaagcgggcgggcgataagggccggaaacaggcggggccgcagactgcacagcagacaatcccgttctgggaaatgttccgagacggagtatgccgcttaaataacggcgtttacacaaagacggtggagtttgaggacatcaattaccagctcgcgcaggccgaagatcagtcggccatctttgacgggtggagctccttcctgaactactttgacagcgccctgcccttccagctctcattcatcaaccaccgttcccggcctgaaagcaagtacaccgtgaatatcgccccgaggcatgacgagtttgacagtatccgggccgagtatgtggaaatgctggaaaaccagattgccaaaagcaacaacggcattgtccgcacgaagctcattaccttcggcgttccggcagacagcgtgaaggcggcgcggccacggctggaacggatagaggccgacattatggggaatttcaaacagttaggcgtccagtcgcgtcccctccccgggcgggagcgtctggaaatccttcacggccagctccaccccggaggccgggaaccttttacattcacatgggagcagataccgcagacaggcatgaccacaaaagacttcatcgccccgaccagttttgacttccgccggggccggttcttcaaagtgggggcaacatggggcgcggcttcttatttgcagataaccgcctcggagctctcggacaaactgcttgcggagcttctggaactggacacggaaatgaccgtcaccatgcacattcagacggtagaccagtcaaaagccatcaagaccatcaagggcaagctctcggacattgacaaaatgaagatggaggaacagaaaaaggccgtccgctcgggctacgatatgaacattctcccgcccgaccttgtgacgttcagcaaagacgcaaagaccttgctggaggatttgcagagccgcaacgagagaatgtttcttttaaccttcctgattgtcaatatggcccccacgcgggaacagcttgaaaacgagattttcacggtttcgggtatcgcgcagaaatacaactgcacaatccggcgtctggacttccagcaggagcagggctttttgtcctccctccccctcggctgtaacgccgtggagatccagcggggactgacaacgagcagcaccgcgattttcattcccttcctgacccaagagctccgcatggacggggaggccatctattacggcttgaacgcactttcccataacatcatcatggcaaaccggaagaagttaaagaaccccaacgggctttttctcggagtgccgggaagcggaaaatcctttgccgccaagcgggagcttgtgaatgtattccttgccaccaatgacaaaatcctgattgtagacccgatgggggaatactcgccgctggttcggcggctcggcgggcaggtggtggagattgcacccaacagcccgcaccacatcaaccctatgagcctgattgccgatttagacaatggcgaagaaaacccaatggcgctgaaagcggacttcattctctcgctgatggagctgattgtgggcggcaaggatggccttcaacccgtggagcggacagttattgaccgctgtgtgcggctcatgtaccgggactatctgcaagaccccggcgcggccaaaatgccgatactccaagacctgtatgagctcctgtgcaaacagacggagccggaggcggcccggctggcaacctcgctggaaatctacgtttccggctccctgaacgtatttaaccatgaaaccgacgttgacctgtcaagccgccttgtctgcctcgacctaaagaagctcggggcgggcctgcggacaatcgccatgctgattatgcaggatttagtcaattcgcaggtgtcggccaatttcgcgcagggaacggctacatggtgctactttgacgagttccatctgctcttgaaggacgagctcacggcctcctactgcgtgaccgtctggaaaatgctgcggaagaaattctgcgttccctcggcgcttacacagaacgtaaaagaccttttggcaagccgggagattgagaatatctttgaaaacagcgactttctcgttatgctctcgcaggcccagggcgaccggcagattttggcgaagcagttaggaatcagccccacccagttatcctttgtcaccaacagcaacagcggcgaagggctcttattcttcggaaatgtgattatcccattctccgacaggttcccgcagaataccgagatttaccgtctcctgaccacccgcccggaggatttgaaagatgaaggggcgggcgtatgaccgggacacttcgggccaagttggcccgaagcccattccagcggtacaggaaatatcaaaggatcaggccgtcaactttatccatcagtaccattattcaaaggtcatgccgcggctgaaccggttttacttaggctttttcattgatgggcggttagccggtgtggtggtattgggatggggtacgcagcccttgcagacaatccgcaagctgttcccctgccatgtactgcggacaacggactatatcgaaatcgggaagatgtgtttcctgccggacttcaacgacacccaatgcttcggaagtatcgtcatttcacagatggtgaaatggctgaaagccaacacacgctatctgtatctttacacattggcggacggtatcatgggaaaatgcggctatgtgtatcaggccagcaacttccagtatgtggggagcttcaccacaagcgtttaccgggacagcctgaccggggagaaaatccacccgcgaagcgcccggctcctgctggaagaaaatgcggcctttgatggcgtggcaaaacgctactggctgacttttggctactgccagtacaaggggattgagaaaatcaatggccgtatgttccgctacctgtacccgcttaccaaacgtggtcggaggattttacagagctacccggagtatcaaggtctggcctatccaaaggataaagacctgttctattccatgcggagcgcccccggcacttacattccaattccacagccccgttttaacaaagaggtatgccagttcaatgtccagagatattgactggcacatttcattttcggggaaaggaggttgattttatcgcaaaatggatagaccggacacccggaaagaaactggacacttcgggccaacatggcccgaagtccgccagaaggaaacaggccccgcccggcccggagccggaggcgacggggccttcctcccgcctgcggtttgaggacgaaggggaaccgggcaacagcacaggccggacaggggaagaaactacctcgggccaagttggcccgaagcaggggcagaagaaattccggcaggacaaagagcggccccggccctcggaacggctccgccgtgaaggggagccgccgcccggagacagcgccaaggaggcccggacaggagcagaccccggcaaaacagacagcgaagggccgcagacacgggaagggaaaaagacggagaaggcaaaggcacgggctgaaaaagccggggaaaagctcggcaaggcccggactaagctggacgcacagaagccgcccaaagagcccggtatcccccgcaggctggcccgaagcgcccgcaccggagcatggatttacgcccataacaaaatacatgaagtggagcatgaaaatgtgggcgtggaaggagcccacaaatccgagcttgtggccgagagaggtatccgcaaggtgtcccgatttgccaaaaggcggtggcgtacccgccacgcccgaagcgtggtgaagtgggagaaaaaagaaatccgagccagtgcggactatgcgtttcacaccgccgcgcaggaacacccggagctatacagcaatcccctgtcccgcttttcgcagaagtggaaactcaaacgggagtatgccaagcgggcgcgggaggcggcgaagcagggcgcaagggcggcggagaaaaccgccgttaccacggaaaaactggcccggcgtgtggccctctttgtgaaacgccacccggtcggcgtcctgattgtgcttgccgtccttctggtggtcatgctgctgatgggcgctttatcctccctccccggcatgattgggggcggggccatgaacgctgttttaggcacttcctacggttccgaggacagcgacctgttaggggccgacgaggactacacggcattagagcgggcgatggcggacgaaatcgccaatatcgagagcacccaccccggctatgacgagtaccgctatcaggtggacgaggtgggacacaacccctatgagctgtcctcctacttaaccgcaaaattccaatcctacacccgcgccgaggtacagggggagcttcaagcagtatttgacgcacagtataagctgaccctgaccgagacggtggaaatccgttaccgcacggaaaccgatacatggacggacgaggaaggcaacagccatacggacacctatgaagttccctacgagtattacattctcaccgtcaccctgaaaaaccgcaccctgcccgtggttatcaacgagcggctaaccgccgaccagaaggagctctattcggctaccatgtggacgaagggcaacaagccctatctgtgggataacatctacacgggcggcgataccgaccccggcccctcctacgagataccgggggaggccctgaccgacccggattttgccgccctgattgccgaggcggaaaagtacctgggctacccttatgtatggggcgggagctccccgagcacaagttttgactgctcgggctttgtgtgctgggtatacacccattccggcgtttacaacctgccccgcaccacggcaaccgggatttacaaccaatgcgccatcattccaaagagtgaagcccggcccggagatctgattttctttacccgcacctatgacagcgccgggtctgtctcccacgtcggcatttatgtgggcgacaatatgatgattcactgtggcgaccccatcaaatatgccagtatcggcacgtcctactggcaggaacatttttacgccttcgggcggctcaactgaaaaaggaggttttgcatgagcagtaaaattgacaaggtatgcgccgagattgagaaggtcaaggcgaaaatcagcgaacagcagacccggctccgggagctggaacgccagaaaaccgaactggaaaacacggagattgtggagctggtgcgttctctcaacctgacgcccgccgcgctggccgacttcctgaaggagcagaaaaaggcccctgccgcttcgggccaagttggcccgaagtccggagaaagaaaggaggaaccgactgatgatgaaaactaaatcccgtatggcggcggcgctggcctccgtttttctctgcctccctgtctttgcccttccggcctacgcgcagagcgccgagcccacggaggaaccgcccgcacaggaggaaaccaccaccgccaagcccttcaccccggagggaaccggcacagtggttgacaacgccaccgacgaggacggaaaagagttttataccattcagaccccggacgagcacgttttctttctggtcattgacaaacagcgcacaagcgaaaacgtctatttccttgatgctgtgacggaaaaggatttgctctccctcgcgcaaagtgagaaggagcccgagacggtggagccggaaccggagcccacacctgcgccgcaggagcccgccgacgagccggaacccaccccgaccccggagcccgaaaagaaagacagtcccatcggaacaatccttctggtgctggccgtggcggtcatcggtggcggggccggctggtacttcaagatttaccgcccgaaacatcaggcccccgatctggacgaggaagaaattgactttgaggaagaaggggacgagccggacgggaacagcgaccttccgccgtgggacgaggacgagccggaggaaggagacgaaccggggaaggaggacatggaatgaattttaccgacagcccctatgagcgaatgatgaagcaggttccccggccctcccggcacgacccggagccctgccctgcctgccgggagcgcggcggtgattgcaggaagaagcggcgcaccctgattgtggagccccgcaggacttcgggccaagttggcccgaagcggtgatgtgccgggagctgacccgtgacgagaggaaaacaatccggcggctggtcacgggtatgtgcgccaactatgacagcgaatacggctgtctcccgctggactgcccctgctatatgctcggcaaatggtggacggggagcctgtgccgctacttccgggcggcggtgctgcctctggccccggtgctggaagcctccctcacgggggaggcggcggagccggaaataaggcgctgcgccgtatgcgggagggcctttattcccgaggggcggcaatcctactgttccgaagcctgcaaggccgagggcaaccgccgccggagccgggagcgtatgcggaaaaaacgggagaaaaacaggaggcggcgttacgattaggccctgtaaaacccctgtgtttctgggctttccgcgcccggtttgagcggtcttaatatcaatctacgtcttgcccctgttttgcggggtaaatcgtaacaaataaggacttcgggccaagttggcccgaggctggaaaggaggaattatttggacgggtataaatactactctacacagcggccagtggatatatggacgttccctgaaccgcccgacaacaagcccgtggagattaaaaactatgactgtgattttcgtattcccataccgggggaagccttccgggcgtggggcgaactgatttacgcaaagccgttgacagacaagcagatggaggactacgaactgaaaccctcccggaaaaatccagacctaaaaaaacgcatggaggaacagacgcaggccctcggaaaatgggagaacagccgccatttctccgaccgcaaacggctgacatggttccacccggattttggttcctatgtgctgaaagactttgtgaccccggaacagctcgcggagcggtttggaattatgcaggaattacaggcggagcgcagagaaaaactttcgattgccgcccagctccgcaagggctcgaagcaggcaaaggatcatcaggagccgcccgcaaagaaaagcggccccgcccatgaggaaagataggaggtatttcatgcaggaaaaggataaccccttgaagttggcggagctctccgctgaacagaattacaacatgattgacggtgtgctgaataatacgccgcccgccccggttcccccggaacaggaaaagccggtggacaaggtgaaggaaccgccccaccacaagcggagccgggagcgggaggaacggtaatgccccgccgcaggcggaatatcccgctttatgtgatggtgtccccagaggaactggaacagctccacgcccgcatggacgaggcaggcgtccgcaacatgagcgcctttgtccgcaagatggccttaaacggctatattctccatgttgacctctcgcccgttcgggaactggtttccctgcaacggcggtgctccaacaatctgaatcaggtggcgatccacgccaacacctatggcgtgtacccggacgagattgccgggcttcaacaggactacgccgagctgtgggggcggatgaatgacatactgaaacagcttgccactattattacattataaagtggttctatgtgaaaggagcttaggaaaatatctaagctccttttaatctgtcatctttaactaacttaactaattcatcataatgtgatgaatcagtaataatttgaaaagtgcaatgttcttcgtttaaggctaattcaagctgtttaaatgaatctttcggtttatctacataatcaccataagcctctaaccctgttacaaaccttttcagaacagctttaatagcttcaaaagattcatctacacctatccatttgcgtcccagttgatatgccgcatccagtgtagtaccagagccgcaaaagcagtctagtacataatcaccttcatttgacgaagctgccacgatacgttttaacaaatctatgtttttttctgttggataccccgttgttttaacattttgatttacagaatccctaaaatccaaccaaatatcctgaaccggtatacctgcactgtcatcaaagtaaacttttcgcctaggatttccagttggcgaccaatagatttcaccattagcgtcaagttcatctaacttttcaggagtaaattgccagtgttttccttctgggggcattttccccctccatggtgaaccagtagctccatttcgcgttcctggagcatggacaggaacttttttatatcttcttccagtcgcttcatcaatacatggatactgttttattatattttcttcactccatgaagtatatggacgattccacacatatttttctgattttgaataaaacaaaatataatcagaaatatttccgtatgtatttttggtataatttttgttgctacatttttttcgtgtaataaaggctctaaaattttgttcaccaaagacttcatccattataagttttatttgaaaagccatattaccatctagatgaacatagattgagccatcgtcggataacaattcttttaataaaataagacgtttacgcaaaaattctatatattgtcctccacataaaatgtcactatatgcatgggtttgatttttagaattaaatgtactgcgcgtggcaaatggaggatcaatatatattaacttaatcttgccaagaaaacatccttcagctaatagttggtgcagtacgtcaaaattgtcgccccagtaaagaaaattttcatttgccgaaccatcagtagggtttacagtaaaactattttggtgttctttgaatgaggcttttaatattttctcaacactatcttttccttcatattcaagcctgattccaattttttttatatattcagaaaaatcaggagaattagctatattaggtattcctgttgccataaatcactcacctattatccaatccatagtaattctttctggaatcatccttaaagttactactttaattttatcgccccaacgctcttcaagttttgcgtagtcatcccacattgtacctaataacagtccgggaccatcattcagaaacatgactttaatattaatgtttttagacttagcataatttaatatttcatcggcacaactggtatatccgccagtcctatcatcctcctgcgcgcctccatgatcgccatcgtaacgtgccaaacctacaacatacacatttttcttagacttatcactaataataaaatcaactggtctatcataattaggatagtctttaaaaattttacccaagagaatatctttgcctgcaccttctggtccccaagttaatacatctgtaaaattggtgcgcataagattgaaaaatttaccagtcaaatcatatccttttttccctctatctttgtattcccaaagaagggcacataaggcttcatcaggaataggccgtgattcaaatttagcttgtactatatgtatggcacgaaatccctctccaaactgttcacaaatttctgctgctttacgcttcttttttaacatttcaacgggtgtttctggacttacatattttctaaaaactctagctaattgaattctcatccacccttctttaatctcggaaattttcataaatagtgagactgagctttctgagctcctaagcaactgagaaaacaacactaatactggtttatataattcacaggcgtctggtaaaatatctgggtaatattctcctgttgatagcgtaatccaattatgaccttcctgtttatagtctctgaaactactcattttagtacctcctatctacctttaggttatgattatagcatagaaaaacataaaagtgaatttatttaaaccaaagaattttatcttactcttcgggccaacttggcccgaagtatctgggacaagatttgcaaagtcccgacaacattgttgtccggcccctgaaatggtaaaattatagtaggataaaacaaagaaaggggctgtttacatgagactgatatttaagatttttgctttgccgttcctgctggttctgtcgcttctggtggcggtgctgatgttcctgtttgaggtggccgggtggccgggtggcttttgtctctggcttccggggtactggccctgattgccgtgggcctgttcgtgcttcaacatcagcctgtcggcggcgtggcgtttctcgtcctggctttcctgctctcgccctatgggctcccggctatcgcggaatgtatcatcagtgcattggacgagctgaactattccctccggcggtttatcacaagctgacgggcggcgggacttcgggccaagttggcccgaagcaggaacggcaaaacggcggctctgcggggccgccgttcttcatggaatggaggtgtgatatggcaactacccgccattttacccggcatatcaacgccggggagacgatagcggaggcaatcaaggactgtactgactatggtaaaaatcccgacaagacccggggaggcgaacttatctccgcttatgagtgcgacccggccacggtggacacggaatttctgctttctaagagcaagtataaggccatcacgggccgggtgcagaagtgggacgaggacattttatgttatcagatacggcaatcctttcttcccggggaagtgaccccggaagaagcaaaccgtattggctacgagctcggcatgagctggacaaaaggcaaccacgcttttattgtcacaacacacattgataaggcacacgtccacaaccacatttactacaattcaacgtctctggactgtacccggaagtttcggaatttctggaacagttcctttgcaatccggcgggtaagcgaccggatctgtctggaacacgggctttcgattgtgaaaaatccgaagccccggagtaaaggcaagtttaagaattacggggaatggctcggaaacaacaaaccgcccacctttcaggagcagctgcggacgcaaatcgacgcggccctcttgcagaaacccgccgattttgccgcgtttctctcactgatgaaggcggcgggctacgaggtcaaacacgggcgcggcggctctctctcgtttcgctgtcccggacaggaacggtttacccgttgccgggcctccacactcggggaaggttatggcccggaggatatgcgggccgttatcgaaggccgcgcccccttgccctccagccgggcggcggagcctgtgaagctgggccgcaggctcaacctgattatcgacattcaaaaccggcttcaaggaaaaggcccggcctatgagcggtgggcgaaagtattcaacctaaagcagatggcggcggcgctggcctacttgcaggacaacggcctgacggagtatgagcagttggagaaaaaggccggggaggccacggagcgttttcacgttctggccggaaaaatcaagtcggtggaggccgcgcttgccgccaatgcggagctcaaaggagccacggtaaactatgcaaagacccgccccgtgtttgaggcgtacaaggcttcacggtacagtaaaaaattccttgcagaacatgaggcggatattgagatttaccgggcggcccgggccaaaatgagtgccattctggacggggcgaagctcccaaagatggagaaacagaaggaggaaggccgcaggctggcggctgaaaaaaaggagctctacgccgagtaccgggaagcccggaaagatatgcgggaagtcacaacggcaaaagcaaacattgattatctgctcggcctgaccgggcaggagaaaaacaaggaacaggagcgatagcgaatgagacgcaaccaatcgagcggagcgacggagcttcgggccaagttggcccgaggttccgcagggtttggggctggccccaacaagcgggatttttcaggtttcggcgggagccggaacgtggaaaattcgcaagtgtatagacacttgcatcgcttgccgtttagcggtaggctgaaaaagataacaaagaaataagacatacatatgtcctattccatgttataatggcatggggtgattatatgaagatagaccgtcttatcggtattattacaatacttttgcaaaaggaaaaagtaacaatttctcaattagccaagcgcttcgaggtttcatgcaggactatccagcgtgatattgatgatatatgtaaagctggtatccctattgtgtccatgcaaggatatggcggggggatttccattgaagaaggttataaaattgataaaacaatactgacacaaaaagaattgagtgctatttttatgggcctcaagagtattgataccatttcaaaatacccttatacccaaagcctgatggagaaactaagtcacgataagagctcaatcctttccgatcaaaacaaaattattattagtttagcctcgttttatcaagtaagcctaactgaaaaaatagatttaataaaacaggctattaacaatcgggaactgattttattccactactattctgaaaaaggagaaagtgaacgtaccattgagccttattttataatatttaggtggtttgcatggtatgtttacgggtactgccttactcaacaagattatagacttttcaaattaaatcgtttaagcaaattacagaatctaaaaacaaattatgaggaaagatttatttcagaaaaagaacttgattttgaccaatatatttggcgtgacgatataaaactggtagccctttttgatatgagtgtaaaatatagactgattgatgaatatggcccggaatgtataacattagaccatcaatctggcaaactgctttttgaaaatgtttttacaaattataattatttagttcaatggatacttagttatggagaggcagtaaaagttattgaaccttgtgaattagtgaatgaaatccgtaaaaaggccaaaaacatgttagctcaatacgaggaataggacataaaggtgtcgtattacatgtgttacgattaaaacaaatggaggaattgaatatgaaaaaagaaatatctattacagataggccggaaaaacttgccggatatgaagcggagcaatactttgctgcctgtggtaatttgtcatggtacgattttgtgacagccatgccatcgttggtattcctcgttacaggctggaaatcgaacggtaaggaaaacgcctgtctgcaatcttggtctacctttgccggaagtggagctgacaactttatatgtatcatgggaaaggttaatagaggcgggcatatgtatcaatcgctgaaagaaacaaaagtatgtgtattaaatttcccatctatcgacatttatgaccgctgtataaaaacgattggcaacaatcagtttgaaacagatgaaattaccgcctctggcttaactgcggagaaagccataatggtcaacgctccacaaattaaagaatgctttttgaatatcgaatgtgaatatttgtgggaacatgagcttttcgagggaagtcaagaagttgcagttgcattgaaagccgtcaacatttgtatggatagagaacgctacgaccaaagtttgctcggcagatacggaaagagtggatatttatatcaaatcgaccaaccgaccaatccagaaacaggtgagatcacgccgataaatcacggaacattggaaccggatgttcctattgagtgggttacgaattaagcgtttgcttcgggccaagttggcccgaagtctataaagtagccgctgctgcaacaaaaaaatgttgtattgtcaaatgaaaaagcgggggctatcacgcctccgcttttctggcttctttggctttttgtattccctttacggtatcggatacaatgacaagatcggtttcatcaacgccatttagaagttcatcgagttgtcggcgctgtgtagtcttatccggcgttttcatcggaaagaaaaactggtctaccgatatatcaaagaaggtcacaagttcataaaaaacttgcaggctcgggtgctggccttcattctcgattgagacgagatagcgtggggcaatatcaagttctttccctaaccgctcccgggtgtagcctttggccttcctggccgctttgatggcctgtccgaaagccttgaagtcatagacttctgttggttttctcataaataaatcaccctattacattgtatagctccaattttcaaaatgaaatgagtttacaacacatagagtttacctaaataacaccaattatgtacatgaaacagcaaaaccgctcaacggtaaataaaaaaaaccgttgtttggcggtaggatagttatgcgcctaaacaaaatacagtagcctaacggcggttttgaaatagcaatcaaagccgtcgttttctttttggaaataagaataacggagggtgtgataaaatcgccctatttagaggacacggcggtacaaggagggtatcgccgtgaaccattatattcgacataatcagtcaaacttctacttcttaaaaaaagcctgaccctttatgtccatagttgcgctcctccatttacctatacacatcatttaagaggaactaatagtgtttgttcttgcgctcgtttggccttgtgctatacgggcgcttttcatttgcggcaaactggcttcgggccaacttggcccgaggttccaaacaaaggggagttgccccgctgccgctccccgccctctccatttcggttcactcgtccaccaaaaccgaaatggaggtatcactatgaagaaaatcaacttgcgggatctgtacccgttttatcataacgacctgtttgtggaagtctctgacgaagtggcggcggctctggccgaggccgagcgcatggagcggaactatatccgccgtgtgtattggaacaaagcgtatttttcgttggacgccggagacggtatcgagcatgaagctcttttcgttgccctgtctccctgtgagctttacgagcgcaaggttacggcgcaggagctccgcgcggccctcgcttcgctcccggaaatgcagagccgcagggtttacgctcattacatactcggaatgagcaaagttgaaattgcaagagccgagagagtccatgagaaaacagttcggacttcgattgagcgcgggctccgcaacatggaaatttttttgaaaaatcgtatctaaaccggcccgattttgcccgtttattctcatggctattgagagggataactacctcgggcaagttggcccgaggcttgaagctcccccgtgcagcttgacaatttcataaaaagatacccggatacgaagggtgtgtatgctgagtgacaggcccgccatgacctctattgccagagaatagagagagcgacaaggcccatgtcgcaggcgggccgaggctggttccgccggataaagcagacaagccttgatacttgcgtttagtcatagtccgagcgttgaagcggccaaaggccgtgagccgtcgcaggcattgagaacgccttgccataagaatggggagaggtgaaattcctatggggtggacaagccgccgcccgtccggggtatctgtgtaagtaaacgatcaggagcgccgggccggatattctgtctgataacagcccaaaacttcccggcgcggcgctccacctatttttgaatagggagaatcgaaatggaaaaagatttgactttggatatgatgttgaccgaacggtggagcaataatgcctgccgcggttacgtcatatgggcgatggaaaactgtgacttcaagcccgagtatattaaacgggtggttcgtgagcttcattgggttttcgatatgaaatctattgaagaagccgacgaacactattgccagagcccctactaaacctctcttctctgctctgacctcgggccaacttggcccgaggtcttatgagcagatggcaaagggcggcgcgtgagaacgggccgccttttgtcatttcctcataggacaatcagggaatgacatacacatggaagaaagggggcgaatatccatgcaaaaacaaattcatttaacggagctcgcgggcgttgatataacgacagtcaacaaagaggacttagttgacgtgtccgggctgaccttcgataacacggttccgagagaacagcgggcggcgcaggtgctccgcaaagtaaaaaatccgtactgcttccgggtgggcgatatgggcgttaaactggaatttctggatagcgccccgccccttgaggattgcttcactgacttccttcaacgtaaaaagagcggcctgtaatcagtgtgcaggccgtttttgtcggcctcgggacaagatttgcaagggctcgacaacattgttcacaccacctatacatggtataatataggtgtaaagtgataaaggaaggaggttcacatggcgcgaaagagccgtgttatcactgaaactcaaaagcaggaaagcgtaaaatcatttgaatggaaaatcggtatttatatcagactttccaaagaggatttaaggaataatgatgaatccgaaagtgtaaccaaccagagaaaaatcaatctggaatttgtggaagaaaaattctgcaacgaaacgtatatcatttatgatatttatgtagatgatggacgctctggaacaacagaggacacacgacctgattttcaacggttatcaaaagacattcgtgagggtaatgtgaattgcgttgtttgcaaaactcttgcccgggcctttcgtaactatgccgaccaggggaagtttctggagcagtatctccctacatacggttgccgctttatcgcatttggcaatccctacgttgacacattcgcaaaccctgactgtacgcaaaacatggaaatcccaataaatggccttatgaatgaccgttacgcggccagaacgtcggaagatgtacgaaagacatttcggacaaaacgcaacaatggtgagtttatcggcgcatttgccccatacggttatttgaaaaatccagaaaataaaaatgcttttattattgatgaagaagccgctgaaattgtaaaggagatattcgagaaatatctggctggtatgagtaaactctctattgtacggtacttaaacgaccatagtattctctgtccaacggtatataaacaaaagcggttaggcttgaagtaccaaaatccgcacagtgacccaacaaaaaaccctctttggagtgaaaagacagtgggggacatacttaaaaatcaaatgtattgcggtgatatggtacaagggcgttatcgtataaaaagttacaaagtccatattcaggagaaagtcccggaggacgaatggtttattaaagaaaaaactcacgagccaattatcgaccgggaaatttttgataaagttcagcggttattacagaaggacacccgcacatctcctaaaaatgatacgctatatttgttcagtggtttcctgcgttgtgctgactgcgaaaaagctatgataagaagtgaagttaaaaaacatgtatattactactgttcgacttataagagacggtcaaaaaaagcctgtacgaaacattccatacagcataaccgcttagaagcggctgtcctgtttgcaattcagcagtatgtataccttgcaatcgactatacaaaaatcattgaacagattaacagggctccaatcatcaagagccaggataagaaattgttggaggctatctccaaaaaggaacgggagcttgccaaggtaattcgatataaacaggctgtttatcaagattggaaagacaacgagattagccagaccgattaccgccgtatgcgggaggactatgaagcacaggaaaaagagataactacaacgattaaaaaactacaaaacgagagggccgaacaagaaaacggtgtagacactgaaaatccttttctggttgcctttcgcaaatacgaaaatgttaccacactatcaagggatattctgattgatcttgttgacagtatcacagtttatgaaggcggcaatatcagcattgttcttcgctttgctgatgaactccgccgggtgcaggattttattgaaatcaacacccattccgaagcggtttaatatgaccgcattttaattgatagttggttttcttattatccatggctccaccggtcctacaggtgcagctggtgggattgccgcatatggcggaatgtatagaacaaccacaacgccaatatctatcggtattgcatctacgcaacaagtagcttttaataataccatgccattattaaatacaaccgtggcagccaatgctattaccgtagctaataccggtatatatgagattaactggaagttagtatcaacagcatcagtggcggtggcattaactttagctatacgccgtaatagtgttcctattgcatcaaccaccagtacaagaaccttatcacttggtgttgaaagtttatttgaaggcagcgttattttcaatttaactgctggagatgtaatagatatggctttgtcttctgcactggccgtaacattaactttatcaacaggaacaaatgcaacattgacagtaaagcagcttagctgataattgtttaaaacacctttgtgttttaaacagtgcaaattgatgtgattatcgtatattttgttttattctcattgagaggatttatggggcataacaattttcccgttatgtacggcccggctgtcccaatgggaccaactggagcataaggacctgccgtaaaccacaggagctgccggcgctgccagccggtagtcaccgcccctagtccggtcggacggaaacacactggcactgcagctcttggtacttctgggaaccactgtctcccaggccggcacaaaagcttcgcttaatgtgagccggcacaacgcaaaatacgttccggcagttcctcgttccgccttatgggagatttggccctgatgaatgcgatatgatgtgtcatatcaagtaaatcagggccaaatataccgcaagtgtagcgtgctttgtcccggctgaggtacctctggtgtactcccaggccaggcagctggaatgaattttaagacacgctttaaaacagattccggaaagcagattccggttcaggacctgtctatccattaaaacaataaggagtgaccattatccccactggtgctatgggagctactggcccccagggaccgaccggaattacaggcgccaccggggctgcgggaacgcaggggccggccggaactactggagctactggagccacaggggcacaagggcctgccggggctgcgggtgttaccggaccgacgggggcaaccggacctaccggagccaccggaccaacgggaacgtctcaaatctccggcgcaatgtcagcacttaatacttcagcaagtaccctttctgtaacaacagatgtaactgatattcctctgccagttcagccctatatggatggatttacggcagatgctgcaaatacagaatttgcagtcgctcaaacagggacttatttaatttcctatgatatcaaaatgacttctggattaccaatgtcatcaagaataacattaaatggcacaccaataacgaattcgattaatacttcttccacatcttcaaatgaatatagtgtgacatttatgcagcctttaactgcaggtgacatattggcattacaattatatggcgtaaatggtccggtttcattacaagccggtactggcgcatcgcttaatattgtgaaaatagcttagttatatttaggcataatatgtcaaacagtacagataaaaacaacttaacgcagcaaaagtcaggtgtcagacaaaagcatctgccgggtacgatgaaggctgtctgctccttatcaggatttagccatatttaaataatattatgactgccaataccgtttttacggttcccgtaaccggcacttaccttataacctataatattaacgcagcagctgccctgcccatgttctgacgtatttttccggatggacactcccatggcaggcatcattggtgccccggctgttgctgcaggccaattctcaggcctctgattcaacacctttactgccggaggcacaccggaacttcaactcttcgttctgccgggaccgtcgtccttcaggccggaacaggggcttcacttaatgtcatacacctggcataatgccataacttcaggtcccaggatatgggggatacagaaataaagcggcaggcttttctgccgcaattacccacccgtgtcttatctttccggacctgcaccattcattataacaaaaaggagagactaccatgtattatgactattcagataatataaatccgcagccgtccaactatgaaacatcctctgcccccttccgccccaataacagcggcaatggcaggagcagatgctggtgtgatccgtgcaatccatgcccgccatccagctgctgcccaccgtccggtcccaccggcccgaccggacccatggggcctcagggaccaatgggccccagagggtgccctggcgcacctggcccagcaggcccaaccggcgccatggggccacagggttacgtaggtcccaccggacccactggcccgaccggacctcaggggattcccggaataaccggcgctaccggtactgcaggaccaactggtcctcagggcccacaaggcatacccggtcctaccggcccccgtggcgttaccggaactacaggtgctgctgaaacgataactatacgcaacactgtcacaagtgaacccgaaactccggccgcagtagtagatataaccggttcccctgaccacattctggacttctaccttccgcggggagccaccggcgctaccggagctacaggtgctgccggacctgccggagctacgggagcccgggggattacaggcgctacaggaaccactggcgccactggcgcacaaggtatcgcaggtgttactggtcctaccggcccccagggacctgccggagccactggtgctacgggaccgcaggggcctgtcggagccactggggctgccggcgctaccggagctaccggagccacaggcgctacgggagccactggcgctgcgggagccaccggagctacaggagccactggagctaccggagaagcacaaaccataaccatacgcaataccacaacaagtgaacctggtactgctgccagcgtcacagatgtaaccggcggtcctaaccatgtactggatttcaccattccccgcggagccacaggacctgccggcccccagggtacaacaggagcaactggggcagccggagccgctggcgctaccggagctaccggcgctaccggagctaccggcgctaccggagctacaggcgctgccggacctgccggagccacaggcgctaccggtaatacgggggtagaaggacctgccgggcctaccggcgctaccggcgccacaggtgctgccggacctgccggagctaccggcgctaccggtaatacgggggcagaagggcctgccggagctatcggcgctaccggtcctaccggcgccacaggcgctgccggacctgccggagccactggcgctaccggtgatacaggtgcagaaggacctgccggacccaccggcgctaccggcgatacgggtgcagaaggacctgtcgggcctaccggagaaaccggacccacgggcgccgcagccaccatcaccatcggaagcgtaaccacaggcgaccccggtaccgaggcatctgtaaccaattccggcacctcagaagatgcagtctttgatttcgtcattccccgcggggaacccggaggcggcggggctccggaagtcctggcaacagtggatacaacccctcagcccacttcggctaacggggcactgatttttaatgaaactccgctggtatctggaactgccattacccatactgctggttctcctgatgtgcagattaaccagcccggcatctatcaggccttctttaccggtacagtcctgattgatgcagggaccaccatcccctctacgctcacggtccagctcacactgaacggagttcccataaccggagcagtggctcgccacaccttcactgcttccaatgaagaagtaaccctttccatgaatgcaccattcccggtaaccggcgctggtactctggaggttgtaaccagcgatgccggatacacctttgaggatgcctccctgaccgttgtccgtctgggagacagcactaatttccgcacagctgtataacaatcaggaaaatgttcactggaaagttaaggccgccggaaaatatccggcggccttacacaatccgcttacatggcagaagccctgaacgttactgcttcccactatattattttacagcaattgcctcgatctcgcagagcacaccctttggaagagtcttgactgccacgcagcttctggctggcttggatacgaaatacgttgcgtacacctcattaaatgtaccaaaatcattcatatcagccaggaagcaagtggtcttaaacaccttgtcaaatccggtgccagctgcctccaggattgctcccacatttctgcagctctgctcagcctgggcagcgattccctctgccacggttccgtctgccggatccaccggaatctgtcctgacgtataaacaaccccgtttacctcatatccctgggaataaggcccaatggcacctggcgccttgtcagtactaagaatattcatctgaaatacctccttcatatttataatttggacataagtccacttaatgttatcgcgttcacattcaactgctccctattatatcagatattatctgccgatgcaatacagatgcttcaatatccccataaaaccctgtaaaggcctgtaaaatacagccctgtccgtattttttccctatgccgtgcatcttcataatcaggtcttcataatcaggcgtcccgcctatggacattacgtgtcccatttgttataattgaaatgttttaatcgcattcacatccaacacaccaacaataaaaccgaggtatagaaatgacaaatcttaacgataccggggagtctattcccgcataccatattgaccacaccctttatgagggccgtcccgccgacacatccggccgtgaggataaggaaatccgcacctatgatttgctggactccctccaggtcccctttgtccgtgtggaccacgacgcccttccaaccattgaagcctgccgcgaggtagaccagcttctgggcacggaaatctgcaagaatcttttcctccgcaatgcccaaaagaccgacttttacctgctgctcatgccaggcaataaaaagttcaagacagctgtcctgtccaagcagattggaagcgcccgcctgtcctttggggaggcagaattcatggagtctttccttgacatcaaacccggatccgtgtctgtcatgggccttatgaatgacagggaaaaccgcgtcaggctgctgattgacaaggatatactggaaggtgagtatttcgcctgccatccctgcatcaacacctccagcttaaagttcacaacccgggatttaatggataaaattctcccggcccttggacatccgcacacagtcgtggatttaccatatgcagaataatccatgtaacagaagagccggcagccacaaaggactgccggctctccctgcattggggtgcattagcctaactatatgcattggggtgcattagcctaacctctagtacttacaatactccttacggattccttccatctcttcatggatggccggaacatccataaccatttccatcattcccacctgttcctcataaacagctggatctgtctcagccttcacttcatcctcacagatatgatatacacttagtcccaactggactcctgccaaaggacctgcataagttggatcgccggctgtaacggtttctgctgcaaggcctgcggcctctgcttcagcagctcccagaagaactactacgttctccgggccgtgctcctcacttatgtttaaaaccctcttctggttttccagatccatggcacctgcggacgttcagacaaagcactctgtggaagagtaggctatctttgcgcctgctgtcttggcacactcttcgatggctggtccgggtacgccgtcgcggtcaccgatgatgatagcatacttgtctttcagtatggccatacattgttcctccttttctttattgcgcttaaaagcgctgttttatacatcagccgcgtctgcggttatgcatcatttgtatccggcctatcggccgtaccctggcatcaggcatatttcctgatcatttcctcgcagccctccggggtggcgtcatcctttaccctggaatcaatcatttccccatccttatatatggcaatcacaggcagtcccagcaccttctgggcaatggcaagccgtctggcctttgtggtgttcagggaacagaattttacagttgttccgtacacctcctcaaacttatggatatggggcataagggctgcacagggaacacagccgtccccgtaaaagtctaccagcacatagccctgggcctttaatacctcttcctcaaaattttccttgctcaaatcaatcatttttaacctcctaaatgtaatcgcgataacttatggttaaatagtttctttatatccatttccaaaaaccgggcttttcaccgtgtttgtccttgacaaaccctggaaaacagataatatattaagttagtagctaataaaattttcatccaatgataaggagtatcactgatgagcgatattaaactgactgagttaacaggttcctgcggcggctgagcgtccaagatagggcctgataccctcgcgcaggttctgcgcggtttaccaacctttcacgacgaccggcttctggttggatatgacacctccgacgatgcggccgtctatcagcttacccctgaacttgccctgatacagaccgtggacatctttccgccggctgtggatgatgcctatgagtacggccagattgccgctgccaactcactgtccgacgtatgggccatgggcggggaagccagactgtgcatgaacattctcatgttccctgagcacctgccctttgaaacggtccaggctatcctccggggcggctatgacaaggtggctgaagctgaggccattgtagtgggcggccataccatcaaggatgacattcccaaatatggcctgtgcgtctccggcgtggtccatccggaccgcatcctgcgcaataattccatccaaaagggcgatgttctgattctcaccaaacctctgggcaccggcgttctgaccaatgcggacaggggcggccttttatctgactcagaacataaggccatggttgactgcatggctgcgctgaataagtatgcagccgatgcggtacgaaacctggacggggtccatgcctgcaccgatgtgaccggcttctcactgctgggccacagctacgagatgtgcggggaatccggacttactgtaatcatagacagcagccgcgtccctctgctcccgggtgcggacagctatgcgtccatggggcttgtacccgcagtggcataccagaacatgaatcacctgaaggataaggtggcgctgccaaaagaccttccgtcccatgtgcacgaccttctcttcgatccccagacatccggcggcctcctgtacagtgtggcatcccaggaagcaggacgtatcatggaagcgcttcagaaagcctgccagtccccggctgttatcggacatgtggacggaccatccgcccatccggtcatggtgatttgacatttttttcacaaaaaggaggcagacctcttatcccagctttacaaaccgggagcggacagcctgcccccttccactctgctacatttagtacatttctaaatatccttacagcagaccagcaggccgctaaggaattttctgaccctcacgttgccgtgtccgtcgctctttcctctgatatagctcatttcccgtttaatctgttccagactgtaaagcctggctccatactcattaaacacaggatctgcataatcatccattcctctgtatgccagattcgccatacccacagaggccgcgcgccgtatgcgctgctccacactcttggaattctgtcccatcctgctgcacagctcacgtaccgtgatgtctcttatgtccaggtcctcctcaatcagatagcggacaattcgtataatatctttgcttcccgcctcgctgagtatacctatttcctgtaagatgctctttaaacgccgtatggactggttataatccgtttccggttcctcaggctgcatctttcgtacctgcacatttgcttcccatgaaaatgccccggcggaaaaatcattcctggccttgacaatcagccactgcatggccctggacatctccatattgtgcagcacgtttctcacttctatctcattgaacggtttatgtatcaaaagctcagcgcctttttcataagccatcctgataatatccatatcattgacatgcgaaaggataacaaccgatgtctggggcagtacctccctgattttctgtatgtaagcaatggttttgggtgcggaaagggtaaggtctgccagaatcatatccgggcacatctcctggagctccagataggcttcctcccatctggatgcaatgccggcaacagttcccataccgccatcttcaatcatgattttcagttctgtccgcgaattcctgtcgcagtccacaatatagattctcatcctatttcttctttaaaaatacatccttaatatttttccataacatgaacagtatcagtactgcgcccacatatccgttgagcacgtagatgatgttaaccaggaccctgaaaggaaggaagagtcccacaatcagtccaattatacccagtgcaactgtaagaagcttaaactggctggttccctcttttgcgaacctgccgcatggattatacagaagcggcactgctgttgtataaataccggcaaacaccacgactgcaaagaaggatgcaaagggcttccagatgcgttctgccaggatcaggttggggatgtctgcattccatacgaagatgcctgtatttcccagacctgctgtattaatattggcaacctgtgccagcatgataaggacaatggcaacacatacagcgatggttccgccgtagatgccatactccacgtctttctttttattattggctccaagcgctgccgtaaaactggcaaaccacagaagcacgaatcccgcataggacagggcggatatcacccagttaggtcctgcgttcttgattgtctcgctgcctgcctcggcaaatgcacctgtgcggataacttccagtccggcgcctacatttccggcatccctgaacagggtaaccacgccgataccgatacagagtacaacgatagccgggccaaccacaccgatcttgtcaaccagtgaattaagtccccctaccacggtaaggattgccagtgctgtcagaaccacgccgcctacccaggaaggaaggccatactgctggttcagtgtagaggcagcacctccaaccataacgaaaaatgacatgtaacaaaatatagtagaataataatccatgaaggtcccaacgtatttaccgcagtaaaacttatatacgtcatttcctttttcaaagtgctcctctgctccggccttggcaaagttgtaattgtagtagatgaagcagaccgcaaacagtaacaccgtaaaaattccctgcaccccgtatgcagtataatactgaataatctcctgtcctgttgcaaacccggaaccaatggtaaatgcgatgactgctccggcaagtataagtacccgtccccagttaactttcttatcactatccatacgccttctcctatccatggtctgatacagcgccgtaacgctgtcctaatttatgccggcgcagcgggcaagctgcctgctgcgccggatttgtcatttctgtattatttctcaaacacagtctggccatcaaccggtgtctgaagtgctttgagagctcttctgaccatggataagcggagtttgtagctgtccttctcgccctgtggcggatcgcccagaggataaggaatgcctataccaggaataatacggttagcgcctattgtcagtgaaatcggaaccacagtagccatgtgaactaccggaatgccgtatttctcgatacccttaaccatcgttgcaccgcaacgagtacaggtacctcaggtagagacgaggataaccgcatccacatgctcatcaataaacatctgtccaatctcgctgccgaacttggctgcagatgcagtcgcagttccggtaccggtagtagtgcagaaatagttcacaagctcgccgaactcgcctgctttttccagttctcttaatgcgtctaacggaacaaccacattagggttggccatagcaaactgacggtcatatccgccgtggatggttgtaaattcatccgctgacagacggtccataccggtgatgtcatacttgccccacttggtggcattggaggactcgatatggtcagggttgccggttggaacgataccgccggaggtaaccactgcaatctttgcgtgcttgatatccttaacaggctcagcaggcgcaactctgtcaaatttaggcataggaaggtctgtgccgtattcctcgccttttaacttcttaaccagcatctcaagggcgcgctcagaacctctcttctcagcgaagtagtttacgcggattcctctctcgatgtatccttcttccttcggtccaaggatttcctcgccggccgccatcttcttaatcagagcggacataacaggaagtacctttggcataccggctgcggagttaggtgtatccacaatgataaggtccttgcggaacatatccacgcccggattctcgatatacataccggtgataaccgggatgcccagacgctcttccactgccttacagatagtaccgcaggcaacgccgtaacgtccggcattgaatgcagggcctgccacgaatacatcaggctcacatttctttaccatctcaataatggtatcggttgcagcgtccagattctctccgaaatagttgtcaccgcagataatggttgatacgatttcataatcctctcccagtgcagccttaagtcccatacctggtcctacgaccccttcccgaagctcaggggtatagtcggctttttcttcaccgccgattccggcaaagaactggttaatataatgtactattttatatttagccatctttccatctcctttattttcgattaatagcctctagctgccagcttgttgaaaccattggcaatggtggaggcgatgataatctgaagctctgcctcaaagctgccgtccgggttcttacagccgtcccagccgccaatctgcatctcgatgaagtcctgtgttccgatgaccttatccatggccgggaactggagtgtggcattaccctgtccgcaggatgccagtgcgtcagcttcttcgcacacgtcagccagggactgggactttccgtccttgcccgggaactcgtcggtaatcagaaccaccttggttcctgcgcgctctaccttacggcagttcatcatcaggtcagtatcaggattgccgtatccctcctcggtaatcagcacaccgtctaatcccatccagttgcacagcttggcaaccatatcggaatgacgctctttgtctgccaggaatacgttctcgtttgtcaggataacacccatgaagttgatatccttgccatggtgcttatagcagtcctcaataaccggattgtggaaatgatggtatgtggtaaccttgtcacatggtgcaacacagttaccggaaacaatagcgccgtccatgatttctgttggatacataaaggtggggataaactgctttgcatccacgccgtagtaatatgtatcatgcagaagtccctgtgactgcagcatgtggatatagcctacctttggaaggtccggatacatggcagcctgctcgaaaataggctttgtctcataagtaacgatttcatccggctccagctctcttgctgcctcgcctacataagtcgctacctttaagcccgccatacgggcagccttctcatatacatgagtctccaggccgtcagccggctccactacaacgcagaggttataggtctgtgagaatgggcagtaatccgcagcagggccgctcatgtcgataacgccctcctggaatcctacgattttaccaacagtcactacacagcagccttccagcgcgtgtgttcttccggtgcccacctgaggacttacctttccgatcacgcctgggaaaatctctccgccgctgaccttaacccttggctcaatcacgtccttaaccggtgtaatcctaacggactcacctggctttgcaatgtcaacgtggcagccggtcagcttatcgtcttccagcacaagcttttcaacttcctctttgttgacatagagcactccgtctttcacgtgagtcttgtcatcgaatcggatatctttgataaagatttttcccaattcaagcttcatatgaaatacctccacttctttatattttactgcctgattgtccatgatattcccatatatccaacttggcaatcctgacagtactctttcagttacaaaatttgggatttgtgcaaaaatgatactttaaattagtaatcgcgataacttatgtctataatataacatatgttatcgcgataatcaatggaactgttgatactttttgttacttcttgtaggaatcgactttttcgtcaatttgttataaatttgtcatgttttttgtgtatattcactatttgggtgtaaaatcataggcatagcactgtgtgatttccttactctcctgaatgaactggttcaccagctccggaatctcatcctggctgatgccgtgctcctggacaaacttaaaatatcccagaaacagggtgcatatgatatggttcagctttttagcattttcctcagaaatcttgccttctgccaccagaagcttacatatataatagtccctctggtaatagctgggtatctcaagcatctccttgatgaaggggcttacctgtatgatggcgtccggaaacatctcatagtattccttcagggcctctcccaggtcccggtttatgttccggtaaaaaacagcttcaaaggcctggggcttcttaaatgcctctttggcataggaacgccatataccgaaatgcacatcccagatatcattccactccttttcacattttgacaaatccaggatatactcgttgagcgcgtccagctgggcataaaacaaaagctcatccagattctgaaaataccggtacatactggcagaagaacatcccagttctgccgcaatacgccggatgctgatagcctccactccctccttctttatgatcctgctggcctgaaccacataatccttcctgctcaaatctttaaagtaggatgttcccacattctttttcatgacttcctcacattcggttccttattatccctacaatttagggattacattctctatcattgacaaatcaatggtcttgtaatcgtaggcaatcttctcgtcatacttaggcaccttcttaatggcggtccacttattgaaggcctctatggcttcctcaatcagacggatatcccccgcatcactttttccggtttcattgtataaaaggatggtcctgtagggagtctggttgggctttaagctggatgcctgcggatgggtcagaagcttgtggtttgtatgaatcaaatccctggtctttaaaagcacctcctcgtaagtctccaccagaaccacctgctctaccttgtctccccatttttctgctgcccggtcattgttggtgaccagaatacatttacctaaatcaaacattgtatcccctcctggttattattatttgctgttttctttaacatctctttaatatattacatcaaattacaaattccgtcaatttatcccgcacaccatgaacctatgctttcccaaattatatatgaaaaaatataaatcctgtaaaaggtgctgcaaagccatcgaaatccatcaattgctgttgcagcaccctgagtcaaaggcaatattcatataggtatttgcgtgaacactatttgctgaaatatccgtgatacagctggaaaaaattgtccgccgtacagccctcgccgccggagaaatcaaccacatctccgggaagctttttaagctttaccgtgtgctccttcacatacggctcatagattcccaggaacgcctttgtcttcttctcctgggccagcctgctctttctggcagccgtagcctcctggtcataggcattgacacacttaaggatataatatcttccgccctgctccagaatcccgctgacctggtcctgctccagctcaaacgcagctctttcaaggccgtccatgtccttttgccattccagcgtcctgtctgtgcggctgtcctttgaatatttggctgcaatagccccaaagtccgctttctccgcctgagccagggccagaacgttctctgcctcagcccttgaatccagctcaatctgctgaatgcctatgaccttggcctccgcgtcactgacttccaggttctcgttcttggtcagctctgccaccagcttatccgcacggtagtattcgcagtacaaatcgtacacctcatcctcggatacatccataaacctgcggtcctgttccgacagattcctgtagtattcctgggccagggatttaagggcatccttttcctggcccgtaagttcaattccctgttcatccgccatcagatttgtggtggccagctcaatcaggaactgctccacctggtccatcagcctgtcctcgaatgtatcaccattctggtctgccttcacagaccagagctcgctggtatatatgttctggtaacggttccgctccgttatggcaatcaccatcatctgccccttggtatactccttgtccactgtcctggctccggatacagcggccgttttcctggaacatccggccaacacagccattgccagaacagctgccagacacaggcccatggctcctttccatctcttcccccgtaccttgtatatcctgcttctgtccactgtcacactcctctcacagcagccccttcagtatcttgaggactccgccccgcacattgctgtccgcctggaacctggctgcctttcgcacctcttccctggcattggctaccgcaaagctgtaataagcctgattcagcatctctatatcgttaagctgatcgccaaaggccatggtctcctctgtcttaattcccaggctttcctggatggtgcgcacagccttccccttgttcacatccttagccatgcagtccatccacatatcaccggcgcaggccatcttagcctggtccttgaactcatcatatatgtccctggtggctgtctcgattccctccttcttataaatggaaatcttcacacacggctcctccagctccagcacatcctttacccggatgacattaaacttataaccgttggtcagccagtcgcacagagcgtcgtccttagaatccagataatccccgttcacaccggcataaaccatctccagctccggatgcatccgtaccttgcgtatgatgcggtgggccagctcacgctccatcgtataggcgtacaggcatctgccatggcatcccacgtacgccccattattggcaacatagaaaatcttcttcttaaccggttcaaacgcgctttccacactggcccacgggcgcccgctggcaaccacaaactgcattcccttttcacgaagcttcagaatgatgtcaaatacttccgggtccaaatccggagaaccgtccggtacaagcgttccatccacatccgatactatcagcttaatcatcttccctgtcctccaaaagtctttttatctcctgatagagacgtcccaccggcagtcccaccacgttggcgtagtccccttcaattccttttatataagcggcaaacctgccctgaatcccgtaagcccccgccttatccaggggttccccgcactgggcatattccttcatttccccgcaggtcatggggtacacatggacatccgtgcgctccgcaaatgttatcccgtggcaccggtcctccccctggcacagaagcaccgtcacaccggtgtatacctggtgggtcctgccctgaatcttctccagcatctcataggccctcatgggggttcccggctttcccagtatctcatttcccacggaaaccaccgtatcagccccaatcaccatggtgcccgcgggacatcccgacgcaacatcctctgccttctgtctggaaagttccatgaccaccctatccggctttttctccccggtctcctcctccatccggctgggcctgatttcaggctccaggccaatctgtgccagcagttccttccgtctgggagacgccgaggccagcacgacctgatatcctccccaagtatgtctcatatccatgtctttctcctttattcaatccgtcacaaaacaccggcgggtcagaacgacgaaaagactgctgcatgtagaccaatggtaacagccacctgcagcagcctttcatccaattaatatatcttcagccggcccactgccggctcatcttcctcttccataccgcccatgcgcaggcggaaacagtggatgaaatccaccagataaaacatggtaagccccactgccaaaacagtccccacatggccgggcaggctgatcacggcggcacgaacccttatatccagaaaataaaagaaaaacaggcccagaagtccccatgcaaggctgctttccagacagaccattcctttataattaaagggtttgtggctgtagtcccaccagaaggagccaaacagccgtaccataatattggctgtgaccagttccatggtagtggccatggccatggatgccgtgtagagctccatgggactgccggaaacaggccgcagcagcatgcaggcacccagggcgccgaagccgtatatgacgcaaaaggggccatggccaaagccacggtccactacaggccgcttatattctgcactcagcacaatacattccagcaggtaaccaagaaaactatacataaaaaaccagttgatgaaatcataaacattcatggtatcttctgtccttcctgtctaacatgataccccccgccgtattaataataggaattcagggccaaagccagtccaattcccaatatagcccctgccagaacctgcaaaggcgtgtgtcccacatactccttaagcttctcctgaagcacctccgcattgagcttaagcggattttctgaaaggatggaattcaaaagcttggcctgtttaccggtctcacgcctcactccgatagcatcatacatgacaatcatggagagcacgaaggacacggcaaactcaaaggacccggccccgtatttaagcagggccgctgtggtcaggccgcagaccgtggctgagtgggagctgggcataccgcctgaccccaccaggcgctccgcgttaaaattcttattcaaagcaaagtcaatcagagtctttaagaactgggcaaccacccatcctgtaacagcactcataagaagctgattgccaagcatctgtgtccatacattcataatcggattattctttcccctttcaaacgggctccgggacggttacagcaaaacgtaagattaccgtctggccggctgtgcaaacaggcacatccgaatccagtgcttaaaccgggccgtggtttccactgtactgcaatatttatccgcacaagtaactgcatatcctgccttagatgtgggaggtacgagggtcaggggccacatgtgcctcagaataatcatccgttcctccccggtcagccggaaataccggtccgcgttcaccagggctgccttgggatgggtgaatccatgaaagtactggcccgtctccttagcatgagtatgccaatcatataaaaacaaatcatggagaagccctgcccgagcagcgcttctccagtttcctcccagctgtttgcacagcttatatccaaggtatgaaacctgtatacagtgggtcttacatgtggtagtcccgtgctgtatgtactggtccatggactggaatacaggatggcacaatatgtcctttacacactccatgtattcccggtcttctgttatctctgaaaccaacgacggctccatatgggcatcacacctttcttagttcatcagcatattatccgacattacaggtctgttgtcaatatccaatcagccaatcataaagttcctggtatttggcggcagaggtccaccaggaataatccttggccatggccctgtcgatgattttattccactcccggcgcttgctgccgtagatatactcggcatagcgcacgcttcccagcatctcatgagcattgtaattggcgaaggagaatcctgtgccctggctctcgtattcgttataaggctccacagtatccttaaggccgcctgtctcccttacaatgggaaccgtgccgtagcgcagagccatcagctggctcaggccgcaaggttcaaacagggaaggcatgaggaatgcatcgctggcagcgtaaatcttatgggacatggcctctgaatagtaaatctgggcagataccctgtcatggtacttccagtcatagtggcggaacatgttctcatagcgctcctcaccggttcccagaaccaccagctgcaaatcgtcgctgcacagctcatccatgacgcactgaatcaggtcaaagcccttctgatccgtaaggcgggagacaatgcccaccatgaacttcttctcgtccaccggaaggcctaactcctgctggagcgccttcttgttctttatcttttcctttcggaaattcttggcattatagttctgggcaatgtacgtatctgtctcaggattaaactcatcgtagtcaatgccgttgacaattcccctgaggcttccggccctggaacgcatcaggccgtccagtccctcgccataaaatggaagcttaatctcctctgcatatgtgttgctgaccgttgtgatggcatctgcaaatacgataccgccttttaacaggtttccgtccttgtaggcctccagcttatccggcgtgaaatagtaatccggcagctcggtaaagcgcttgatggtctttacatcccacacgccctggaacttcaggttgtggatggtaattacagacttcatattgcagaaaaactctccctcgcggaacttatccttgagaagaacaggaatcaatcctgtctgccagtcatggcagtgtaccacatcgggctggaatccaatcacaggcagcgctgataaggccgcccggcagaaaaagcagaacttctccagatcccagtaccagtccccgtatggctttgcgccattaaaatagctctcattatcaataaagtaaaaggttataccctcatgtacatactgcatgatgccgacataacggctctgtcccagataatccatatagaagtggtgtacgtatttcatcttatcgcgccactcctgtttgatgcaaaggtacttggggatgatgaccctgacatcaaaatactctttatcaaagcattttggcagggagcccactacgtctgccagtcctcctgttttaataaacggcactgcttctgaagctgcaaatagtattttcttcatcaaaacctccctctcctgacgaacaggttccatatgcctttcctaatagtataccttacttttccgaaattaggaagttgtttctgatgaatttgtcttaaatttttttgtattccaagagtattttatccgatatcagcgcaatgaattcagaattggtaggcttaccctttccggtactgattgtataaccgaaaacttcatcgatggtttccatcttgcctctgccccaggccacctcgatggcatgacgtatagctcgttccacccggctggccgttgtctggttgcgtttggctatggccggatagagaattttcgtcacgctgctcatcatttcctggtcttccaccgacatggcgatggcatcccgcagatactgatatcctttaatgtgggccggtatgcccagctcatgaagcatctttgtaatgtccgtctccagatgctccttcatgtactcttccctggtgatatgggattcttcccccggctcaaaaggagccgttattacttttcctgccgactgtttattgggcagttttccaatatgacgaatcttgtttaccaggatttccttgtcgaagggtttcatcagatagtaattagcgcccgccttaaaggcatcttctgtcatctgttctccacctactgcactaagtataatgaatgcaggatttttcaggaaagtatgctcgcttttcactttttccaccacggatataccgtcaattttcggcattaccaaatccagcagtacaatgtccggcgttgtgtcaacaatcatgtttatggcatcagcgccattgtctgcctttccaattacagataatccgtcttctgcgttaatcagttcatccagcgtattcagaattagcggattgtcatcgacaatcgcaacattcagcttttccacttccttttacctcctaaaattgtttgcctgtgctgaactacctgccaaaaaatcggtagctgctattcgaccaccttaacatcaaatccatctccttcgtcaatataactcctggcgaaatttattatatatggtccccataccatatagcaacggttcgtggtcgcaattttagacacgcgtcgagattaaattgtatcatttttggtgtcattttgcaattattaattatatcgattaacatttctgtaacaaataattggttttattcctttattttactttaattcgacaccatttttgtaatttcagcacgttgatgtttcatttcattatattctcacaggcacgattatagaacgcaaacatctctatttttcctcctgatatttaaaactttggcaaaatcgaaggagggggagaggcgggatttgtcgaaatttgccgagggggtggtttggtgatgatagggaggctgggacagaggtgagcacagaggtaagggcagaaaactccaccacatactcactcaaaatcccatcccctctgctggcatcctgcacaaacaaattggttacttcccatgccagttttccatcccgtataatcagcggcccgctcacgattcaagtgtcagcatgatatatggcggcgcatcatgccttgaagggctttggtttatatgttcccgaccctgcaatggacctgcaaagatctactgcccataatttttccgtttccccaatcggaaatacattatctgtaatcaaagtaatcggacaacatcctttctgcaccaaacgatgaaaagtgttcttcataagtttcatggatacattatccaacttttcaactgcgatcttatggcctgccccaggtgtcaaacctctgccaaatgcagccatccttgcacataatagttctctgttctgatataaatcactgtaatcagcatcggctcccacagcatatagcaggcagtctgctgttaatttcaaatcagacgggcaatttctcctggtctgcaagccttgacatgtagtgacaatctgctgccattgtctggatgtcagagtcctgtcgaaatattggtttggcaaaccatccgcagtctcgccgccaaatgagattccggccaatctgttccacataccttttgtctcctttttcaagagccatttgcttaccaggtattcctgatgcaaggaagtggcacaaagcaaacccagcatccttgtcatatggactgcaagcatcttgcagctgcgttcattggtattgatccggtttaataacagaataaccgttactacaggaagaaaatcaaattcttcaatctgggattcacatatggtttcatcgaacccactggcaagcataacacccggaccacctaaccagtctttaaggcagtggttgacagcagcataaatcataggctttctttcttttggcatatttggatttgtcaaaaggcagtataagtaaaccaaatccgccgagacagaagcttttggtaaatccattaaaccgtccatagaatcctgggacgccttcttcacggcttccagataatcgttaaaccgttgaggaatatactcctcaatcttatcaaaattcattttattatttacatagcataacctgcctgcagccgccacccaaagtgatacattaatcctccttctttgtgtccctgatggaacagcaataatcctttcttcttcttttctgacaatatctaccggtatgggttctcctgcttttaaatccaattgactttctgacatcaagtaaatgatatctccgtaaggatacacccgccccaagtaaacataggttccatccacatctctttttaccaacactctcggtattacgcgatactgcttaccggactgggtaatataataattcatgagattattttgggcggacaacaatgatatcgtaccatcctcaagaatggttgctttaagacggtgtgcagaatctgcgcacaggacatagtacacatgatctattccggcccccaatgcacggcaggcctgttttacaggcagccataacggccttaatgtctcacagtccatgcacagaataccttctgcctcagataccgaaaacagcatctctacccttacctgtgtagtttcataactgtcttccagtcctggtttccagcctgtatcactttttctcatccagaacgaatcacctcttgctgataattcacgaataacaaccgatcttgcctggctggataaacctggcagaatcccattgccctccaccagaaacatgtatcctcctgcacgcagaatcacgccctggcaatcctgtccacagactttttctcctaatatattacaacagacttctgtccctccttccagcttcctcgaagaaggctgagggtacgcaacaaaacatttaatgccattctcatccctgacgattcgtttgattaccataggaataccatcgcggaagatattatttctggcaaatctcctgtcccataaatactccctcagccagcctgcatcattccacaaatcttcatatgcaagactaacacgaacatgtggcattcctttagccgagaggtgattatccgtatcataatacacaaaaagaacatccccagcaataagttcctggccttcttcatatttctgaatcatgttatccttatcaattccaacaagcatgccttcttcccagtaatcttcctccgccgccggaagtgtcaggctccagaatccgcctcccagtacaacaccccccggttcttttctctggacaggcagataaaccgtcccattcccaaaaacactgcgtattccaaacctgatattctccaatagcaacattgttaattggctgacagaaccttttgtttcgctgagcatgaccatatcccccggcgagataagctgtgtacacatattacacaactccttcttcttatcccctgcaaagagaaattttctgggaatctctaatacttttccgggaaacaattcaatccagatgctttccttacctgagcctgccactggataccatcccttatcttgcggcagcccattttcaaagatttcacgcgcagaatatccgaatctctgaagttcataaaaaggataacgcagcttgtctccttttgataaaaacaggggaatatcaaaatattgatcacccattggccatttcatgggaataagttcgtttgtttcgctatcccatacacctgtatacctgtcatgataatgccatctgccccgttttacatgatgtatgatttctgaaaccgttccatccaaaaacgtaatttgattccatgctgtctccacggtcatggaatccggtgaaatcttttcgagtacaggagtcctcaaacgctcgtcgatacgtaagtacgccgcgaacaccctggcatccggcataagggttagttttccctgttcatcctttaataaatatcccaggcgagggggatccttcacaatctcccgtcctaagaatagcggattcctgattcgtatctgcggaaaacctgcaatcgtaaaatcaggctgagcctgtttttccttttgtattacttccttatcttctttttccataatggattttccataattcctcaaagctccatccattataaggagttcaacagcccgtcccttgtcaggtatataacaaacatctcccggcaggatcatctctgctttcatctcgccatccagtatttttaaggacgccaatgccccggtctgtaagtttcccgtgttcttttggtccttaatggaacttaatataccaggggagatttctatctgcatactcaggtcaggcaaacttttccccagtgtcacaagacacggctgctgatttttgacccattccttaaggcttttttcagaccgcagaggcgtccctgttacatttccggtccagcttacaggatctctttcgctccttttctcaagtttcaccatcatgttatatttatagtatttataagggtctgaattctgaagcacgcgaagcttactctcatccagagaaaacttgcgccttgaaacagacacgaccatatgcggggaatccttcctgttttcctcccgccccgcatccctttcaggaagttcatttggaagataaaatgatatatggcaatcattcttaatacgctttccctggagtacagctacatctgagatccgcccggccaccagacataggaccttgccctctaataacacatcctgagccgaacttttattcagaggaatgtaggtatatgtatgggaattcatcctttcctggttatcattcagcttaagatgggccaggataaaaataacatcttctccattatcctcttccaatattttctggatactttcttcatccagctcggcatttggtatattttcaaatacccagccgctctgtccgatttccctggcaactgtagatacctgttgtatcacaacctggtgtttatcaataattttcctgacctctaaaagctggatgacacccgccctggtatcctgcaatactttatattccaaatcatggagtatgttgtccgctgatacaagcattttcagcccaaattccccgtttccggccacgacgctgaatttgttaatccggtcattgaaaaagagttcccttaatatcagattcccgttatagtccgtcacatcctccgcacgtaccaaaagagtataaccatatccccattcaaaacgcaggcaatcatcttcgtcacttcccgcataataaagactctgttcaatctcctccccttcagccgcgttaaagcaggagacaaattcataatccaaacgcattggatccgcctccctgtaggatgcaatccaagcattctcactaaatgataatttcacccgcacatcactgtttttgtaaggatgtcccaaaaccagcgcacgttcacctgattttaatggaatctcatttttccatatatcctcaggtccataccggtcaatatggacgggaacacttaaatcctgtaaaaggatgtactcttgaccatccactgaccgtttaatacctacggtatggaaatcgcctgtctcaacccattccagataccgcttcaccttttcctctctctgttcagcctcctcatcttgcttatctgtctgcctggagtatacaggaacaaagattcttcggaaatcataatagctttcctcttcacgccgttcaatctgtctgatttccagtctcatcctccagtcagatacctggttaaaattatcttctgacctggcttctcctattatctcaatattgttcgacagcaagcgtacaatggacgtcatgtaggtccccctgaaaagatacgtatcgcattttctgtacgcaatcttccggatttttccgctcttttgtattgtctcatcccctggtactccctgttgaccccaaaggatgttctctggcttataaagattcagaacaggatttttttcgtcctgggccgccatcatggtgcccattcccttaacctccatcaaccccacagcagtcccctgtacagacacatttttttccgccttatgattggaaaccttccataatgcccgtacatagacaattctcggctgaacggcaaacttccatccctccaagtccctgatagcttccacaggttccccaatcagggcaggaagcggattaaacgcactcatcggcaccctggcaaaaatgattttttcatcaatggcaagacagacatttatgtaaagggatggattataatttcccgaagcgtcgctggggatttctgctatgacacctttgacaggtccctgatacagttccagttccggtacatcatatgatacgacagagttgttttcctcgcgttttccccttatatcaatatattccacaatgcatggacgctcatatgacagggacgaattataatcctgaccggaatttttatttccatagcaggaaaaggtttccgctgcgcattttactgcaaatcctcccatcaatgaggccggataatatccgtagtctgtacgtctggtatttacgtaccggagtctgaaaatatctccggttttcatattcaatatccggtataattcattataattgacatatttgtaatccaatctacggctcatcaccagttcagccttcagcctcccctttcgctgaccagccacatcccatccatcgtcggcaatctgcacattcagacggcttgaattccccagtttccgtacatctttagctataaccacctctatatccttgtcaattccaggaacagaagaatgcacgtaccactcgccctgtacattcttagtgatggaaaatggcgcgtctcccataaactgtgttttccactggatattcttatcatcaaatggttcctgaccatatagttgtaaaacaggaagccctgcagcatctggctgtttaccggataaaagctgcatctgaacgattaatccatcgcaatcctgagtctctaaaacccagttttccaatctttctctgcactcatgtgtaaaattctggtcttccaggcaataattatatcctatttggctgctgaaaagccacaggttcttcgcaccttctctccatctgttaataaatgtaagggtaactttattttccggattatcctgccgataaatttgctcaattatcaggcgtgtaaaattcctcatgaccggaatccaccccttattgtcgtaatattccacgatgcagcgtccttcaatccaaggctccatcaaaatgagggataaatcggcgttccaaaatttcaaatcattaatatcaaatacacccttctgatcttcgccaaatacccgaattgacacctcgtcagccttcaaatgataccttacctccacggagtctccgctttgtggagtccaggcttcaggcatgatggcagtgataatgccactattaatttttaccgctatctcatcccctctgtcatatcggtacagacggctgtctaccgtatggaaagacagggcagtcccgcttccgcagtttataagataggtaacccctttccggtctccgtcaaactccttttgaataattatacccagataccagcagtcagaccggatatcctcggtctggtaaaataaatttctaatggttccattactgaatctggttcttgatgcatctgtagcgagccgtacggacagaatatattcttctcttttttgccacatacagcagcgcagtaattcatcctgtcccaatgcttctgactttacgtttcgcagctgtctgtccttaatgtttttacgtttccagtattcttccagttcattttttatatccggattcttcaggcgctgggacatacgcagaatgaaatgatttaacaacgcgatacatgcatcaacacgttcaccgtcgaaacctgctttgtctgaaagctgactctgaacactctctataaaatccacacgaagctgatcaaaagactgttcccctaaaggcgggtcctccacagccaataaatcggacagcagatattggtaataaatcatactctcggtactgaattcattgatggcatgtatcaccagattcaggacatcaagcaaactgtccgcacttgtttcatcaacaggaaccagtttaagaagctttatcagctcataccgggacagacgtgaaaactcccacctattacggatcgacgttattttttcaacccacgcctctctccatggatggcccctgtctacctgctgcgagacataggccgaagccagccgcatggtcaatgccagcttatcagcgtctttcatgaaacggctggtgtccagagttcctaatcctgcccattcatcagaattcaagggctcggatttaatcaaatcctgcgtactcaccttaaaggtgctattgtcaatgtaattttgaacccagccatgacggtccgttgtcaggtacctgggatatgcctgatagatgagagccagaggctctctggaattacaaatctgcggcttttgtgacattaatctgcacagctccgctaaattggatgcatccccttgttcatgccacggattcatatccccatagcctggtaaaccttcttcagacaggctctgataagcccatttggcagctaccatatatgctcctgatgacaacaggtattccagctgctcattatctgccttttcatccggctgtagaatatctacaatccggtaaggaatcatgcggttaattttccccatacctatgtcggcaagcagatggtcaatatgatatcccaacaatcttaccgctggtgaccatggtattttatgatccgcagaataaatcttttccggcctgttaaatacagactgcgctcccctgctggatatgacgtctccccaatgaaggagcagatgtatcatccgggaagatatgatgtcctctttctgatataaaagaaccgctttcattaccggaaccgcaataaatatatggacggccatgctattgctcataaaactcccatatttatagaaatccttgttttttcctgacgcgttagccgccatgtcgtaatgccggacccatggacactggatgaagccaggcacttcattccagctattaatctggggacgggatggaaggaatgttttttgaacataattgagatggatggaaggatctgtcaatccttccctataatcgggtatctgccatatttcatctaatttcctgatacaatgctccggtgctgcccgcagggcatacatccacaaaataccctgccatatggatgcacatattttgataaagtcattattactttttgttttatcaatccagcattcatcataataagagatgcccgacttaaagtattctctaaaaaaagaaaattgatatgtttctttaaaaatcaggtccaccgtataacctgtctgaaatggatatttaatctgggccaccagttccattaaatcaggacgtgtaaaccagttttcaggaataatgctcatcagggaaaactctgaatcccggcatcgaatcaggatgcctatagccagattccatggaagctggccgtatttaccttccatagcactctttatgagcggtaagggattctctcccttcacaagggaaatcacctgctgcggtacagcttttgccactgccctgagaagggacagatacagtatttccttcccaaacaaatctgtctccagataatcaaaattccgttctgattccatgtaggagttggctttcgacagggtctgggaaatggttgcgataatcttatcatagtcatcaacatccaacccactgacagaataattaaaagcatcctctttcctgatcatattgcgaaagatattttttattgtctccacatatagttctttgtttttgatatctgtttcaaccgccagacattctcttccatggggagtgagcaggctatcaactaaaacaggtaccgcataatactggaacagtacgtcaaaccgtatcagcctgtttagtgcatccacctttgtatccataggaacatgttcattctctaaggcaaacatcaagtttaagtattcatctgtatcctgaggtgataatttagtttggtagcaaaaataccagtccgcgtaaatcatagcttcctcctatgtctctcacttatcattggtatataccaggctccgtatataatccacattctcctgcatataaatatcccctgtcagggatctgtcctgacacaaaatgtgccggaccatatcctttctatatgtatcattcataaaacagattactccttcaagcccataaggactgttcagggataacacccactgttttaccggattccccttcatgcactggaacaaatgtctgtagtcttcacggcaggcagcatgtccgagccgtgcaatatccggatatgcaacgttctccattgcgtccgaatcctgtatatgctccatcacattgattgcacatcgaagcgattcaggtacccactccagcaataggttcagcagattatttctcgccggcgaaggttcccgagtcaggagaaggtatgtctcccaagttaaatcctccaggtcttctttatcaatgctatgtaactctggattcaatgtgttctggacaacaagcttttccggttttactgcgcgcagccattgtatgacatgctcatggataccggccgcggcgagaaacccccgtatccatcccgggtcgttgcgtttcagcgcgtgcctttttagtaataatccccattgtgaaggatatctgtttctgtggtcaagcaaccccaaaacttcttcttccgcaggaggatccgttttattatatgtttccacgatctgatccaccgcgcgaatggtatcctcgttttcggttcgtatggtttgtttcatatccgccacaaccaatacctgtgctttctcaatatcaatcagattcctcattgctgtctgtgcacaccttgccgcaaaataaggtgattcagaccatatattaataatcagaggttgattatccctttcttccatcctctgctttaataatatcccaagattaccgatcagcatttgttccgatgaaatattgactatcctgccaaaattcccttgctcccccgttttaaaaacatcatttagggaatattccctccagaccggagcctgccattgcagccctgttgtcctgctgatttccatgtactgttctgactgatgctgcaggcctttcgctaatccctctggtatggtgctggccaaaaacagggtaaaacgttcctgccttcctaaaagcaaggcaggcagagaaatgacattcttatcattaagcggcactgccatatccagatcaggatcccattcttcaggaatctgccaggctaaacagttcagatccaaaacaggagtgtttacttcttctgattttacattcttctgagactcagcctctccatggctctgcaaatttctgaaacaggccaggtcataccacttatcatctctgaaccgtctgccaacggcaggatccttctcccaacgaccgcttccgccacggccacctctgtatgtataaggtgtaagatggtatctgcacgttgaggaatcacattcaccatataaaaatgtgaacacggaatattggtccggtatccctccgccgctggttatttcctgtatatcgttcccggcatggtccatccggcgaattccgggctcatgcgcatgaccgcagagatatacatccacataagaagaatcaaatagtttttcaacttccgcctgctcttctttttccaaaaaacagaggccatgatgtcccattacaaataacggcttgtttctgtcggcctgattcattacactatttaattctctggaacacaaaaagagattcctttcatccttgttgtcacatgatgttatcgcagtattgataacaatcagttggaaatcctccagatcgtaaaactgatgcaggtcgttaagctcctgttctgtaatcttccggtcaaaccatctgtcatagtgagatacataggcctccagcctttttttagtcaactgattaaaatcactgtcatctccctctccgtttttttcttcctcttccatttcacgcctgagttgatccagggtcagtgacttttcccgtatggctttaataatgcgcgcataagaattttttcgccttatatcgtggttccctgccgaccagaaaatcctgtctttatccacccccaaagtatttacaaactcctcaatccatatatcctggttagcatcatatccattttgattcacaatatcgccggtaataaagacatatagattttgattcttcttaaaatcctcctgtttcaggcactgaatcagttcctgtctaatccgtccctccacaaacccttcaactgatttcaaatgaagatctgaaaaatgaagccattgaaaatctttcataacatcccctgtataaggtatctctatggcaaatacccataccttgtcccttctgtaatatttagatttcattataaacatcactatacacaccctgatgttttttaatatgcccctcctttatttataccacaaaaggaaaaaaaaatcatagtttttagttattttttccatacttcacatgtttattttcaatataacgtaactattcaccaaattaaatacgattttattgtcattccatttaatttcctacgaacgatataggcaaaaatcatgccaccatcaaacagatcaattgccagctcctacttcctgtccaatctccttgagcaatacccggaaagcatataatggcagcattactgttggacgcaaaccaagtcttataaaatcaaactccagccactaagctcctgcttgcatcgctacccgctgcggcttacgggcagcaaccactagtccgcttcgcgtcccatcggtaatggtatttcttcacatagaaaaggcagtttatgtaagcaagctccctccggcctcccgttattccgaaaggaaggcttatgcgagcaagctcccaatgccttccttttcactatatcctccccgtcctcaatgctccatcatattctcaatcaaaattccataccctctgctggcatcctgcacaaacacatgggtcaccgccccggccagcttcccgtcctggataatcgggctgccgctcattccctgtacaatcccgcctgtcagctccaagagctccggatccgtcaccttaatgaccatactcttgttcttatgtccggaattatagtccaccttttggatctctatggcgtaatccttcagctcgccggaaatattgctgcggatataagccggtccctgctttacatcctggcggcaggcgatttccatgggttctcctgatatctgctttttaaactgctggttgaccgtgccgaatatgccttcatttgtgttcttttctatatctcccatatgggactgggggccgtagtaaattacgcctgacagcagtcctggttttcccatggatcctttttctattcccatgatttccgtggaatacagggctccctcggaggattccactaaatcgcctgtatcgctgtcgctgattccatggcccagcgcgccgaacctgccgttcatatccacatacgtaatggtgccgataccctgggtatcgtccctgacccatgctcccagcttgtactgcccgtcagcgccctggaccggcttcaggcttatatccacatcctcgccttccctgcgcacctggagcacgcagtcctggccccctgactcgctgacagcccgtatcagatcctcctttgtgttcatgggctttccgttgaacgcttcgatatagtcacctgatttcagtattccgtatgccggttccacctccataccgtcgcttcccgtgattcgcccggtgccgatgaccatgacgccgtcggatttcagatagataccgatgggtgagccgcagggaatggcatacctggtgtccaccacatccacctgtatgtcctttaattttataactccaaacagcttaagacctacctggtagcttcccttttctcccccgaacatggaaaaatggtccctgccgcttatggtaatctgatctgccggtatattgctctcattggacagggctacctcctggctgtcgctggatatggttgcctttaaaggcaggccaaaggaaaattcctcctcttcattttctataatgctcacccggtccggcactgcctggtccatgtaataccacgtgtaccccgtaacagccacagcggacagccagaaaatgcgccccagccaccggtaaaagattgatttccccttcatcgccctgcctccttatatagtcattcatgttaaatgggtcaatacaaagccatagttcctccatttggggatgaaccacaacaaaaaaaagaaagaagcaacgttcaatgcctctttcttagtattatccatcctcagaatttcaatctgttttattttgttctgtctgccaattccttcatttcacctgcgtttttaagcactgcctccgtaatcctggcgccgcctaacagcctggccagttcttctacggaagcctgcctgtctaacagacggatagtggttatggtcctgccctggctggcagattttgcaatttcaaaatgtgaatccgccatggccgctatctgcggcaggtgggtgatgcagatgacctggtggctctttgctatgagcatgagcttctccgataccttctgggcggttcgcccgctgatacctgtgtctatctcgtcaaaaatcagtgtgggtatatcatctgaatccgccagcacagtcttgatggccagcataattctggaaagctctcctcctgacgccacatccttgagagggcgcatgggctgtcccggattggttgaaatcaggaactgggccccgtcccatccggatggggtaaaatgatccagtttttcaaattccatgtcaaattccacatccaggaaattcaaatccaccagaccctgcttgattttctttacaagcgtcctggatgcctttttacgtatccctgttaattgtgtgcagagtttctccaaaccattcctgcattcttctaattcctgctccatacgctttttgtgagcgtcatagtcttccagttcttccagccttttctttttttgttccaatttctgacagatggcttccacggttggtccgtattttgcctgaaggttatgtatcaggtccaggcgctcctcggttttcctgaatgtttcctcgtccatctccatggaatccagataggcagacatctctcttcccgcgtcccgcagtatggaatccgcatcatagagctggtcccggatgccgcccaggctctcatcgtactctgacgcctgctccacctcttttaaagcccttgccagccattccccctccactgcctcgtaggcggcgcccagacactctgcaatgcgcctggaatgggaataacggcggtaaaccgaggtaagctcctcctcttccccttccttcagggccgatgcctctatctcctctatctcaaaccggaggaaatcagcctcccggatacggctttcagcatccaaatcaaaccccctcagcttttcttcaagggaacggtatatacggtacctgtctgcaattgtctgtttaacaggctgggtcgcggccttgacataggcgtccagaatttcaagatgcttggatttgtaaagcagggactgatgctcatgctgcccgtgtatatccagcagcaggccggtaatctggctcagtctggccatggtcactgtctcatcgttgatacggctgatgctcctggcagaagtcagcttcctggatatgattaccagtccgtcctctgtaggttccacatccagctccctgagagccttccgtttttcctcccctgcaacggaaaacacaagctcaatataggcgtagtctgccccgggacgtatactgcctttcggtgccttgccgcccagggccatggttacggaaccgatgataatggattttccggctccggtttcaccggtgaggatattgaggccctcaccgaattccacatccgctttctcaataagggccaggttttttacatgcagttccagtaacatattacaccccttttccgttagtcttccaccattttcttgattttctccatgacaatgatggtatcgtccacactgcgtatggcacacatgatggtatcatcacctgcaatacaacccacgatttcgtggaactggatggcgtccagggcagcagccacagccatggccatgccggatacggtcttgattaccaggatattctgagccatgtccatggacatgtatccgtccttaaggatgcggatatatttgatggcagatgtccccctggggctctccaataccatgtagcgctgtctgccgctctccgactgcatcttggtcagcttcagttcacggatatccctggaaacagttgcctgggtcacattgaaaccagcttcattcagcctttcagccagctcctcctgtgtctctatctcatactttccaattaattcgacaattttgctgtggcgctctaccttcatgtgagacgcttccctccttgttgatttataatgttctgcggaccctgctgtctatattcctccaagatggttgctgaggttctgcataaatgatatctgctttacctttatcatcactgtctgcagctcggaacaccgtatgtctatacagtcccctgcctttaattccatggacgtatccccgtcaaaggatacgacctgaccgctgttaaggaccttgatcctaaccctgtcctccggtgccagcacaatactcctggcattgagggagtgggagcagataggtgtcagcaccatcatcctggcacccggcgctatgaccggtcctcccgccgaaagattataggctgtggagcctgtaggcgtggctaccaggacgccgtctgccgcgtattcattgagatactcgtcattgacatagacgctgtagcgaagcacctttaagggatcctttctggtaatggcaatttcattgagggcgatatcctttaaaagagtctcttccttccgccacgctgtcccgtgaatcatcatccgccgttccagctggtaacgctcatttaacagggactccaggaccggcgcaatgtcttcctgtcggctcacctggttgagatatcccagatggcccctgttcacccccagcatgggaatgttgcggcccgccaggtccctggcagcctgtatgagggtaccgtcccctccgatagttatgacgcactccgtatcctccggcacctgggccccgtcgatgtgggctgcccccctggttctctcaggtgtatggtgcaggaggcattctgctccctttgcctccaggtaagccttgatgaacacctgggcctcctgtacatattctttgtcaagattggcaataatataaaaatgtttcatggttatggggctcctgacgtttttatacgttatttatccatttgtgcaaaccgccggccgtttaatccagacatccgtgggcctgttccacaatggcacgggctgacaattcataatccggccgcttaatttcttcctgtccggctacttcctgtccggttgttccctgtccggttgttccctgcccggttactctctgtgcggttacttcctgtccggtttcctcctgccccgcctcttcctgcggatagttctggaggtacagaagatattctatgtttccctcaggccccttgatgggagagaattccaggcccagtatgccaaaaccaatgctccgggcataatccgaaaccatctctatgacctcaagatgaacgctcttttccctgacaacgcccttttttcccaccttttcccgtccggcctcaaactggggctttatcaggcacaccacctgaccgttatcggtcagaagctgttttaccggtcccagcaccttggtcagggatatgaatgacacatcaatgctggaaaattcaatgcggtcccctatatcctcaggggtcacgtaccggatgtttgttttctccatacagatgacccggtcgtcattgcgcagcttccaggcaagctgtccatgtcccacgtccacggcatacaccttcaccgccccgttctggagcatacagtccgtaaatccgccggtggaagcccctacgtccatacataccttgccggccagctgaacgccgaagcggctcatggccttttccagcttaagccctccccggctgacatatttaagggtgcttcccctgacctcaatctgtactgtctcctcaaaggacgtgcccgccttatcttccttctgtccattgacatagactatccctgacataatcagggccttggccttttccctggactccgccaggtttctctggaccataagcacgtccaaccgctctttcttcattaccgttctccttataccgaagcggcatttccccgctgccttccggctcagggtgcaatgccgcctgtattatctgctatctgtcaatcctttttgccgccataccctccggctctcacctgtccggaaacgcggtttcaggcttccttcctgttcagaacagggcggattcccaatgtctcccggccgatataaccgccggtcttcatggtccggataatggaatcgctgtcgattcccagtccttcccttaatatggacacattgccgtgctccacatatgcgtcaggaatggcaatattaagtacctttacttccggatagttctcatgtatgaatgcagtgaccgccaggccgtaaccgccctggagcacattttcctccatggtgacaatcaggcggtgattcttcgccagacgtgataccattttcctgtcaaagggcttcacaaacctgccgttggcaaggctgcatctgtacccctccgccttcagcttctgccgcacatgttcgcctgtgctgaccatgctgcccacagcgagaagggcaatatcctcttcctcgtaaagtatttcacccacaccgtatgatatgggctgtctgaattccttcagtccccggtacgcctcgcctctgggataacggacagccagagggctgttataatccatggcaaagtccagcatggcccgaagctcccacagattctttggggccataacgctcatgttgggtatggaggtcaggaaggaatagtcaaagattccctgatgggtctccccgtcgcttcccacaagccctgcccggtccactgcaaatagcaccggcaggttctggatacagacatcgtgcaggacctggtcataagccctctgcaggaaggaagaatagaccgccaccacgggcctgagcccggccgcagccatgcctgcagcagacgtgaccccatgggcctccgcgattcccacatcaaaaaaacggtccggaaacttctttccaaatgcagccagccccgtaccgtcaggcatggcggccgtcactgccaccaattccggatgctcctgccccagctgacacagctttctggagaacacatccgtataggatggattcttctgggatgacagggattttcccgtttttatgtcaaagggacccactccgtgaaaataggatggattcttttccgccggacggtatcccttaccctttttcgtcatcacatggaccagaactgcgtggtccagcttctgggcctccctcagcaccttgcagagggcctggatattgtggccgtccaccgggcccagataggtaatgcccatattttcaaacagcataccgggtataaacagctgttttatgctgttcttggtgcgtttgattttatctatcatggcagtgcccaccaccggaatccggtccagggcgtctgccacgctctttttcaggtcgttgtagccgctgcctgtgcgcaggccgtttaagtagcgggacatgccccctacattttctgaaatggacatcttattgtcattcagcacaatgatgaaattcttcttcatcctggcggcattattcagggcttcatacgccatgccgccggtaagggccccgtctccaatgacggataccacacggtagtcctcacctctgatatcgcgccccagggcgattcccagccccgcggatatggaggtggagctgtggcccgtgtcaaaggaatcatagggactctccttgcgcttcgggaatccgctcaggcctccgtactgacgcagctcgtcaaattccgccatgcgcccgctcaatatcttatgggtataggactggtgccccacatcccatataaccttgtcctccggaagatttaaggtcttaaaaagggcgatggtcagttccaccacgcccagattggaggccagatggcctccggtatggctgattttctcaatcaggaaggtccgtatctcctgggccagtatctttaaatcctcgggcggaagggctttcagctcctccggccctttaatttgttccagtatcataataacggtatctccagtcttacttctgacggcccaccaacgcgcggattaactgctccaggaaatcattgttccccggaagcttgttcagctcttcaatggcttctgtagaaatctgttccacatccttctttgccttttccaggccttccagggttacataggtcgtctttttattcttttcatcgcttcctgaaggtttgccggtcacatcctggcttcccgtcacatccaggatatcgtcctgaatctggaatgccatgccgattttagctgcaagggattccacaatcttgcagtcctcctcagcagcgccgcccaggacagcgcctatcagcatggaagcctctatcagcgctcccgtcttaagacggtagataaattccagcttgtctcccggtatcgggcctccggccagctccacatccacggtctggcctcctatcatgccgtacacgccggtcttacgggcaagaatccccatagcccgcccaatcctggataattcgtccgggtcaatgcttgtctcaaaggcattggcagctgtctcaaaggcatacatcataagggcgtccccggtaagcacgccgatgtcctcgccgtactcagcccatgtgctggccttgcccctgcgcatcatatcatcatccatacagggcagatcatcatgcaccagagaggatgtgtgtatcatctccacagctgccataaagggaatcacagcttccagaagggtgcctgtgaaaagccggcacatctcctgcatgagcatggggcgaaggcgctttcctccagccttcatgctgtaattcattgcctcgaagatagtcttctgatggcctgtttcctccggaagataagttccaattaactgttcaatctctgctgtacgcgcatcaagttcctgtttaaatgtttccttatcactcattttcatcaccctcactcaatatctgaatctgtttttctacattgtctatctgaccgctcaggtacttcaccagcttcatccccgcttcatagcaggtgaatgattcctccagcgtactgtccccggcttccagtttttttatgatttcctccagctgggcaaaattttcctcaatgctggctttattctcttccttttcctgtgtgtccgtcttcttacgcggcatcctctatccctcacttcccggcagtttcatggattccgtctccacaacccgggcgtccacacgcccgtccttaacgctgacgcatattatgtctccaggctctgcctgtgtaatggaggtgaacgccctgcctctggcgtctgtcacaaatccgaatccgccgcccagtttcttaaggggcgacaatccgtccagtctccctgacaacagggccagcctgtgcttcccctctgtaagtcctaaggccatacgcgcctcaaggcgccgtctcctgtcctccagcttacgccgggacaatcccagattttcttccatcatccgttccaggcggctctctatgtccgccaggcgctgcctcctgtcgttgagctgcttttccggacttagaagctttaagcgcataccgaactggtccagccggaaatgcagcttttccagcctgcgctccatggagcgctccagcacctgtctgtacagattcacctgctccacaaactgaccataatcaaacacagccagttccgctgccgctgacggagtgggcgcccttaaatccgccacataatccgctatggtcacatccgtctcatgccccacggctgagataaccggggtggtacagttaaagatggccctggccaccatttcctcgttaaaagcccagaggtcttcgatggaacctccgcctcttcccacaatcaggacatctaaccccatacggtccagagtctctatgccctttgcgatgctgtactttgcctgctctccctggaccagggccgggtataatatgagctggacatagggattccttctggcggatatattcatgatgtcacggatagccgctcctgtgccggccgtgacgattcccaccttcctggcatattggggtatgggctgcttgtaacagctgtcaaacattcccatttcctccagctcattccgcagcttttcaaactggcggaacaggtctccttttccttccctggtaatctcctttgcatagagctggtatcttccgtccctctcgtacacatccacggtgcctgacaccgtaacctcctggccttccctgagctcaaaatccagccctttcctctgtcctgcaaacatgacagcagcgatctgcgcgccgccgtccttcaatgtaaaatagatatggcctgatgtgtggtacttacagttgctcacttccccccgaatggaaatccggttcagggcaaagtcctgtgtaaacatgttcctgatatatgcagttacctgagatacggtgtaaacacttgccatacgtcctgcctacgcttcgctttccttattctccggaatttcctggggctcctgggaagcctgaatctcctgcggttcctggggaactggagtttcctggggctcctgagaagcccgaatctcctgggaagcctgaatctcctggggctcctgggaagcctgcgtttcccggggctcctgagtttccccgcaaaccttgttttcttccggcgcttttgcctccgcggcagccctggctcccttgactacaaacttggccagtattccgtttacaaaggacggagaatcatttccgccgaactttttcgccagctccactgcctcattgatggataccttttcaggaatggcgtcgtcgtggagcatctcatacagggccaggcgcaggatggtcagttccacctttcccatgcgcttggtcttccacccggcggctgcctggttcagcttctcatctatctcaggaatcttctccattatgtttgctgttcttgcctgaagatattcactgtctgcctcttttaattctactttatgcaatacctgaagaatacccgactcatctacatcgtcttcttccggggactggaaatactggcccagctgggctatggcctcttcctgcgtcgggtagaagtcagccgagaacagcatcttaaaacaatgctcccgcaattctcttctggtcattttctctgcttgtacaaaaaagcggtggctttccgtacattttcctttcttcgtgatgtccgcttcttcccttgtctgggcatgtcctaaatagcccggagatgaagccgctctagatattatagcaaacccagtgcataaaaacaataaaaaatgtataaaacactccccaggcaacgctccggggagtgtttacagatattatattaaaccgtggttttatctgccttcatccatattgactccggcaatctttacattcacatccagtactgtaaggcctgtcatattctcaatggctgtgcttaccttttcctgaacctgctcgcttacagacgggatgttgtatccgtagcggatattaagggacaggtctaccgacacatgctcctccgtcacatccaccttgacgcccttgctcagattcttcatgcccagcttgcctaccagctcattggtaatgttgccggccatggaatccacgccctccacctctgtggcagccagaccggcaatgatagccactacctcgtccgcaatctgcacctcgcctattttctctttctcgtataatttatgggtactgcgattttcctcagacatcacaacttacctcctgtcaagacttaattattagtattataacaaatccccaaggatatgtataggattaatttccgcgtcctctcctgtcctttctcacgtttctctctccggctttttctcagccgaagccgttcaggcagcgcatttccccgcaaaaaggcagtcaggaagcatttgatgtccgcgacaattccttctgaaacgcgttcaggtcctgtcctttcagggcacgctccagaagctccggcattttctggggattgcaggcaaaacagggcacatccatggacgcaatcctgcccgctatctgctcgtcataatagggctttccgccgtccgcaatggccaggaggcagaccactgtcacaccggattccttcatctcccggatacgccttagaagtccggcccggttgccgccttccatcaggtcgcttacgagaaagaacagggtttttcccggattctccataaactgctggcagtaggccacggatttctcaatgtccgtgccgccgcccagctggaatccaaacagcagatccacggggtcttcgcattgttcggtcaggtccgtgacctttgtgtcaaaggccacgattctggttttaaccgacgcaatgctggccagaatacagctgataaccgaggagtagatgaccgattcccccatggaaccgctctgatccacgtccagtataaccgtatatttattggcggcgttggacgtggtccggtcataaaaataaaaatgctccggcaccagcctctttaattcaggattgtaattcttaagattcctgcgtatggtgtccttataatccagggccgccgccgacggaatgggggaatgtctccttctgtccacggcagcggtcactgcccggcggatatcatcggccagcagcctgttaatttcctccacaattctggatatgaacgcccgcacctggtccttggaccgccccggtatctggtcctttaaggccagtatcatggaagccaggttcatatccggctccagattctccaaaagctccggctcaaacagcagctgtttcaggccgcagcgctccattgcatcggactggatgatggtcaccagctccttgtcaaacagggttctgacatcccccagccatttggaaaggacaggggcagaagggccgtttcctgcgcctctgcctcccggtacctttttgccggatccgtctccgaatccgccggagtccgtctgattatagatggacgccagggcctggtccattaaaagctgttcatctgtcagctccacaccgcccatttttccaaactggggactgctttcctcccccagtatcaggcgccatcgtttcattctggtttcaagctccatatattccacccatcctatatatcgtcaaagtcaaaaccgtccaggctgtcaagcagctccatttcctctccctttaacggcccgttcagcatctctcctgcctgggccgtgtccacctgccatatctcgcccagattctcagccacatccagcttttccctggaactgaaatcagcaaacgccctgcgtaagaacaccagggcccgcttaaattcctgatcatccagagtatccatataggcactcagctcccgccacaaatccagcctggcaataagcgcataccggttcttcttagacaaccctgcaaaccatcctgcccccagttccgccggaatccccctggaaagacggcggcggacctgacggcttaattcctcttcctccatccggccccgctccagcaggatggcggcagcgaaaccggatatgcccgtgttcaggtcatccctggaagctgtctccgcaagcaggcggataaaacgctcctcatccagaaagtcatggtggaggcacaggctgttgagctgatccatggcctccataacgcccttttccgcctgactgccacaggtacaggaattaagaaacaccagacaggccctaagaaacatctgattcagtacaggaagcaggggtgtgctgtccagatgacgtatgttgccgaaccgcaccacagaggaaatgctctgcgctgtcccggccagctccatgaagcctgccgcctccaccgaaagcccctgcagaatatctgttgcgtaagcaaccatctccggtataccgcagcagcatgcggcctcaatgatatccgccgcctccccaatctgctccgccttcacggcctgctccttcatggcaaaggatgccgcgccggccacagtatctcccttcagggcagactccaccaattcaatttccacttccggggtccaccggatatcccagctctccgcccaggtggcagcttcctgctgctcctttctcaggactgcgaaatgtactcccagcacacgcaggcggtgcaggaaaaatgactggcgcagctcccggtaagcggctgcctccgatttcacattcagtttttcccgcaggtccaggttcagggtaaaggcagtctctgtcttatacttttccagtttcagttcccttagctgcctgtaaaaatcgtcctgcaggcaggtccggctgactccctggggaagctctcccacagccgttcctatctccgtgtccgctatggctaatgccagttccggcagactgccgtgccccatggccgtcactgcggcgtccctcaaatcgcgcagggagggcacgctgtatcccttaaggcaggccagggacctggccagttccactgcctcaatgaccccggcagaggataccggaaaaccatgctgcctctgatagccggatatggctgtaaggtagcggtaggttcccatgtccctgtcgccctccagcagtgcctgccacagcatcccgtagtaggcaggcgcctgattgcccgccccatagccggagcgtgtggacaaacggtaataggaatacggcatcagcgtcacattgcagggcacagaaggcagcaatcccatctgcgcatctgtcatggcaggctcatctccggccagtcccgccacatgataagcacctgtcactgccacgattcgttctgcctggaatccctccttttgtgcgtcctccagctttcttctcatatatgcttcccgcacaagtatctccggccagtcgctgtcaccgcctgctgtcagctcccgcagctgccgcccaaaggcgtccgcgccgtcccggtacgcctcatgattttctgagtgctccatgacacgttcccagaaggtctcatggccgtcctccccattaaaccggtccaaaagcctgtacacatgctcagacccagagccggacgtatgttccggggacgcctgggcctccccggcccgccggattcccaaaaacacatccgaaggcaggtccataaaccggcactgcgccccatgttcttttgcccagactatggcctggtattccggagagtactctgcaaaggggtacaaaaccgtgcgtatcggagagtccttagtaaacgccatgatcgcaaacggcggcttggtctcctccctcaccatgtcatccatcagcccgttaaaatcagatgggccttccaccagaatcaggtccggctgtttttcatccagaaagcctctcaaatgataggcgccggccggcgacagatgacggataccaaaacaattcggatgtcccatctattggttcaactccttacactctttataaagtccaagccaccggctgccgcgtttcttcataacattttccaggtattccttccacgccagtccgtccttatcctcatccttgactacagcgccctgaagggcggatgccaggtcataatctgttatttccccatttccgaagctgcctgccagagccatgctgcccgctaaaagcgaaatggcctcggcagtggacaacacgcctgaggacggctttaccttctgcctgccgtccagggtcatgcctccccgcagttccctgaaaatggtgcataccttttccaccacctcgtcatggggaatccgggccctgagctccaggctacctgccagctgctccacccttgacttcacaatctccatctccgtggacatatcggacggcggcgggaggataacgatgttaaatctccgcttcagggccgcggacatctcgttgactcccttgtcccttgtgttggctgtggcaatgacggaaaatcctttctgggcaggcagttccagcgccagctccggtatggagatgcgcttttccgacaaaatggaaatcaatgcgtcctgtacctcactggcgcacctggatatctcctcaaaacgggcaatgctgcctgtctccatggcgcggtatacagggctttttatcatagcctccctggacggcccctgggctatgagcatggcgtaattccatgaatagcgtatgtgctcctccgtggtgcctgcggttccctgtatcaccttggtggaatccccgttgatggctgcggtcaggtgctcggacagccaggactttgcggttcccggctccccgatcaggagcagggccctgtccgttaccagggtggcaatggcgatttccaccagcctgcggtttccgatgtatttgggtgtgatttcctttcctccaacagttcctcccgtgatataggtgaggacggaacggggactcattctccagcccgtgggaaccggatcctgttccgctgcaatcagcgcgtcaatttcctcctggtagagctgttccgcaggcagtcgctgcacgctctcttcttttcctgctatttttcccatgatatcctccaagtctcactttattttcccgcagatacggtctgtcagccctgtcccggcagaccggcagcctcgttgatggcctttctgcaataatcattggcatcccagcttcttctctcggagcttcctttcgggaagccgcacaagatacggtcgatctcccgaagctccgtctgacgctcctcttctgtcatgggaagctgattcatctgatgctgtacggaccacagcgatatgccggcattgggattctttttcacatatgtgcttataagtcccttgaaatccttccagccgcactgtgccagaatgccgtacagctcccggttatccgtcacggtcagggccctcttataaaaataggatcccttctcagcccttttcgctgccggcagcatggagaacaggattttgtcccggtcagtttcccgttgtctgcccgctgcatccagtcccccggctgtgtcatttccaaatatcctggcatccatcagcatatccatccatcgggaatccggcttctcataaagcctgcgcccgatgcggtgggctgttccggacttttcgtccacacggcagaggatttcacactccccgtcttcccggatacagtgtatccggcccagcacagacagcacggcctttctggtcttgcgtttatcttcttttcccagcagggaatccccgggaatctttctgcaataggattcatagacaacggcagcgggttttgtcagaaaatcagctgccagggctggtcccagccagctcctctcctgctcaccggccagctccccagccagggaaatcagccgttcatcccggctgtaaataatggaatccaccagcatggcggggaatttcagccagaactccgggcccgccgggttcatacgggctgccctgcggtatacttcctgcatggccccggagcctttgcccggaagggccataagcagctggctcataagtccgtcaaactcttttttgctcatggtttccttttggttcagggtttcttctattatcccggccagccggtctgaaaccaggtcggattttgaaaagcggagataacccacgatctcccgccctctctttttaaactgctcctcccagtatgcatctgtctcttcctgctccatcatgcccagcacctgctctgtcatctccaggcatagtcccttttctgtccgtgccaaatctaacagcacgcctgtgttttccgtattaaaccggagggcatggatagcctctgccctcagttccttcttcgcccgtttaagaaggcccagataaaattcattttccgccccgccgcatatggactctatgaccctgagcctgtgtatccgcccgttatccgtggtctcccagaatccccgcttcacaagcggaacaatctgtccatccttcccagacagaaacttctctgccgcatctgctatctctgcataccggtccgaaagagccgttatgacagccgcctgcagacggtaatcctcaaaaacaaggggatgctcctccatggcctcggtgatgggcaccagccgtcctcctccggactccgtcagcgcctgctccaggggatgaacccggctgtagggcaggcacggcgcataactgcgtgatatcagctccagcggccggggccctgcctcagcccccgcctctgattcaggccaggtcagtgcctccccgctgtcctgtcctatatgataaccggtctcatatccggcctgggtacacaaaagggcctctgacagggccagggcatctaacagacagccgggacggtcctcacagtccggggccataacgttttctgccattgtatacaatttttttatcaccggcacggcctgggccaggggccggatctgctccactgccctcctgagccggaaatcatctccaatcaggttcaccccggccactgccgctgctccaaggcgctcatggagttcatataatccctgcaattccatggtaattccttcctttcctggttctgtccgtcaatagagcaggcggaccacttcttttgccgtgatgattgaataggggtgcagacatatcctatgtctgctcctgtcataccagagaactccgaacatcacctgatttcctgccatctgcctgtcaggcaggatgtccaggcggcagacagacggcctgtcccccggcctgtccttcagttctatggtgctgttgccgcagtacattatgtattcccgctgctcccccttgacgccttctgtgccgactgtccccagcccgtcataggataccagacagccgaaccgcccgtccgacaatgtgtttttaagctcattctttgccgcctttaccagttcgggaagggatgaagaggccttatcacgggcttctgccagcagttctccggtcaccggcaggaattcctgtccctcccagcgtatcctccgtccgttctctcccggataatacaccagcatgggcaccctgagcgcttccgtcacggaatcctcttccttcacatacttgagggccttcacggggcggtaattataggtaatatcaatctcaccgctgtccaaatccagccaccagcccttgtccaccagttcccttctggccccgtcatagctgacatgaaaggacagctggagcaggcgtacgttttcctttttaagccccagctctatcagcctctccaggttccagattccgcccagctcctcatacaggacgcttgcgtcatcctccacctggccctgctccagcttttccgtcagataagcccttgacttttttatcagggcccggagaaataccaggattcttacggactctttgtaatccccttttccatcctccttaagccgcgaaacctccagcacaagggactgcaccaatctttggggacccggaaggtagtaatcccccagctgctttgccaggtcctggtataccttcaccgatgttccgttcagggttcccagtcctgcctccaccagctccctcaccaccttctccgccaggtccagtccctccagctgtttcttaagcttctttgtcctggctgcctggttcgtctttttaggagccctgggcctgtcaccctgactctccttttttcctgccctgacatccttcttcgcccttttatccaatatatcctggggaatgtcacagatatcccaatggcggccctgtgacagctccatcatgagagccagaccatgtttgcacggaaactgcctgctggggcagctgcagcggcacaccggggcgtcattgtccgcaaaatccagggtcaccctgtaggccgaactgccgcttcccttgcaggagcccatgtaaaaggtgtcgtcctctgaccgggcatgttctgtgaaacctccgcttttgacaatttttcttgcattattgaccgcattggcattgggagccatggcggcaatctgctgttccgggatttccctcataatatcctccatcctgtacacgaactgcggtacaactatgtgattggtcatttattccattatacggaaatttggagggggttgcaatggaaagtggggcaaagcgtaaaaaggctgccgcctttccggtctttcaaccgttaaagcggcagcccggccttctgtgttccttctgcctattctgccatattgagcagtgtaatgataatctggtctgctcccacctctgccttgcgtttcacaatgtcctcaatctgggcccgctggggatccgttatggaaggagcgttgatgaccacatccaccttatccttggtaatgctgacaaccggatctgagaagccttttgccatcaggagggtttctgcggcattttccttctcggaaacctcggtcaggtcaatcatgtcctgaatggcctgctgtttggctgcttcgtcaatgctgtcactgttaatcaggctcatcagtgtctctttgtttttggcgcgcacctgctccctgctgagctgcacgtttgctatgtaatcagccacgttcatgccgctggtcagtacggcttccccgggattctccaggccggcctgggcggagctgtccgtatctgccgctgccatctgccccggatcagctgcctgggtagcctcctcaactcctgtgccgtctccggcctgggccagctgtccctggtcagccccggtatcggctgccgcctgggcgccgtctgcgtcgcttaccgcatccaggtcagaagggtcctggtccaggctgggaatctcctgtagtccggcctggccgtttaaggaggccgcctggttctccgccaggatatcttcatccgaaatgtccatggcgcctgcctcatacacccggttgccgcttgccaaatccttcttccccgcgtagttcagatatccggctgccgcaatcatgacagccagtgtcgtgatgatgatttggttcctgcggaagagacgtttcatgttcatgtccttcatgtgctcttttacctgtttcatattcttgattttcatatcctgcactcctttatttattccaccctctttaatacttttattttatgtgccggcaggccaaataatgcttccatagcctcagaaatttcagcttttacagttgggctgcctccgccctctgcgctgatgatgattcccgatatctccggactcagttctttttcaacaatgggcgcgtttgtgctgctgccggaaccgcttcctgccagtatggtattctcctgtatctggttgtttgtcacatccctggtgcctccccctgaatccttttcctgggtggtactggtattcgtggagcgatccacccgcagcaccttttcgctggaggatttaagcaccaccatgacatccaccttccccacgccgtccacggactttaatatattcctgattctgttttccatctgtgcttcataggatccgtcctcggatgtgcgggccgccgccgggtaggaatcttcccggccgtctgatgcgcctgccccatttccgtccggcccctgggtcatcccgttttgggaggagccctggccaaagccgctgtcctcaccgctaccgtttgtattgtcctttgtccacagcggaaccgcccctgcgccctctgtgccggcccccgcggtctgccccccggcattcttatccttcctgcttcctccgggcaggggaaaggagagaatcatgagaagaactcctataagaagcaataacagccacttttccttagtcatttttccattgaatctggatatccgattcttccagcccatagtactgcgccacctttcctgttaaatggtttatttttttgtccgccgccatgcctcctgcctccccctccccctgttccggtgtgtccccgttattctccactcctccggtctccggcagctttcccagctccacatcctcaaccttcacactgtcaatcctccccgcgtccacattcacaggcctgctccccatataatcccagctgccctgctctgtatccgccttctccccgctgatgaccagaccgattccttcaatctgcccataacggctgctgtttctgtcaccgtcaatctgtacgctggctccggtgcattccagtccctccgccctggccatggcctccacatccgctgccacggcctgctcatattcacggatgacctggtccagacgccgttcttccatcccccaaagatcctgcttcaagtcatccgtatcattctgaaaagaaatggatttaaacatggacgatatctgctcatccaggtgcagccctcctgtaaatgggctcactaccagaagaatcaggaccatgcccgaaaaaaagcggatgtatttgccgtatttggaatccgccagaagattatttaccacagaaagaaaaatcatgtagtatatgatgttcttcacccatccatagacagcttccataggcatctccttttatttaacacaataggttccgggatttttcagtctgctttgctaggaggcaaaataattcacattggtggtggcgcatgtaatggctatggctatcataaacagaaacatggagtaaagcacaatctgaagcagcagcttatgtcctttggacacgcccgacacacaggacaccacccgtttgtcacacacaggctgcatcacggcagccacacactggtacatgatcatgaggactgtcagcttcatcaccggaacaacggatatgacagccaataccaccacggccgcggctcccattgtattcttaatcagcacccctgaccccaggaccatctgggccatggccccggccccctggcccagccccggaatcatttccatgagccgtttcattcctgcctggcctgccgcgtcagcatagggaagtatcatggcctgtatgagatgaaatcccaccaccagcccggtcagggtccgcaggctccacaccacggcctgctccagcagttcagtcagctttgataaaagtgcctcctttgccacatggcttcccagcaccatgagcacataaatcctgaccatggatatgaggactgtgctgcacagccattgtaccccggtcaccgcgcccagcatacactcatacagcgccagtgcgctcatgctgcccccggaaaacgccaccgccatatagtaggccggcataagcagcttcatgaattccagtatctgttccatcacctgggccgccacctgcaggctggcggaaaagctggctgccagacatgtaaacagcaggagatatgtaacaaaaaaacctgtgtcggaaatctggcctcccttaaatacggaagaaacattggtaaatacagctccaatcagaccaatggcagccacctgaaacagcatctggctccccctgtccacctgcgagaacagagcgttcttaagccccattccggtctggcccaggatgccctttaagtttcctttcatcagctccttcatcagctcccagaaggaaagtccttccattcccccgtcctgctgtcccatcacatcatccagaaactgctgaagcccctccatttcatcctgaagccccatgtcctgcaaagcctggtccgcccctgtctccgccccctgctccccgccggcgtcccatccccgtcccggggcctgttccccgccaatgcctgtcccctgtccccccgccgaagcgccgtaaacaggtccgcctgcccatcccaggactccggcaaacagcactgccaggccccacagggccgcgctcctgactccccatttcttccatctcttcatcccaaaaatgtctccaatgtcccaaaaagtgccagcagaatgggcatactgatacccagaatggacagcttcccgaatatttcaatctggtttcccagggaaccataccctgcgtccttgcagattccggatgcaaattccgccacataggtaatgcccaccattttaagcagggtcaccagatacacgctgttgaccttgatatagccctgaatccgttccagagcctccagtatatccttcagctttccggtaccgtaaaagaagataaaggcgcctgccgccataaccatatatgctgcgtattctccctttaatccctttaactgcaccgccagcaggaccgtggcaatccccgcagccgcaatggtaataattgtcatatggtttcctccctgaaaaggcgcgttttacagcgcaaacagattcttcattgtctcaaacaggtcgtatatgtaaggtatcatccagaataaaaccagcaccagcccggccagactcgtaagaaaagcctgttcatcccggccgctgtgctttaatacctggcagatgacagataccaggattcctactgccgctatgcgaaatatcagatttacacccattgccgtctcctcaatcttcttaaaatatatttataaatgtgtcctgttccgcacagtcacatcgccatcgtgaagcatatgtccctgacttgtcttaaaacattacaatcacaagaaacatcccgcccatgattcccaggcttgtgtacagcctgcatttctccctctggttctgcctcagataatcaatcgtcaaatccagctgttccagatacagcttcagggtccgttcctgcatgtccacatccagataccccagatgctcccccagatgggccagctgttccaaatcctcctgttccaggggaatggggcccgaatccgtattcaggttcatcacctggcgtttccatatctcctgaagggactctccctcctgcatataaattccctctgccgcggcctcaaacagtccccccagaggtcccggctcccgtttccccacccgctccagggcttccgccagcggcgcccggctgtatgtaatctcgccttttaagaaatatatcatctgcctcagggtttccagcatcctcagccgtcctttccactgcatggcagaccagattcccagcccgccagcggaaaacagcaccagtattgcccctgtccatttaaatgccgccaccttccgactcctttccgcttccatctgcatacaggacatttcccctgccgtcccatatagacgccacatggcctgcccttccccggcagtccagaagaatcatccgctcaaaggcgccctgttgaatcagctctcccacagccggcttctgcatgatatcctccagcgaactgccgtggatggtggctgccagagaacagccgcagtttctcacatattcaatggcctgcacgtcctccctgctcccaatctcatccaccgctatgacctggggcgccatggacctcaccaacatcatcatgccctggcttttgggacagcagtccagcacatcggttctcatgcccagatcattctggggcactccctggtagcaggctcctaactcagaccgctcatccaccactcccacggacacccccggtatccttctgccggatcgctgggtcctgggtccgtccgagacctgacggatcatgtcccgcagcagggtggtcttgccgcacctgggcggcgatatcaccaatgtattcaggaaacggccatcgtctgaatacagataatccatcacctggttggcgcagccctgaatctgatgggctacacgtatattgatgaaggagatggatttcataagccgtatatcctgtccaaaagccatggtcctgccagccacaccaatccggtgcccgccctgtatggtgataaatccctgacgcagctcttcttccgctgcatagacggaaaagctgcacatatattccacggtctccttcatctgagcctggctgaccgttacgattccggccctggcccagtaccgctcctgctcctggcagcggccgcttccccggatatcccttaccggcggatcgggaacccccaccgccaggcttccatctgttttaaccgcatattcccggccgccgcagataagcagcagcggcttctgggtcctcatccgtatctcctgtaccctgtcgaaatccacagtaacctgtccaagtactgcacgcagatcccttgggaatatttttaagacttcttccctgccagccataatcttcaccccttttacctcaatatatgaaacgtgtccaaaaatatgactggagccgaaaaaaaggcagcaccggcccggcgggggctgtgctgccaattctgattcatctgtgtctgttttatctgtcttatctgtcttatctgtttccttctatctatctatctatcttcttctctttaccttcttaacaatctgtcccgtaggcctcctgtcaatcttgtatacaatctgcataaaccgggccacctcgtcccaggcttcccggctctcaggtaccaggtccatgctcatctggaacacatgaaacattccctcatacacggacacccggcgctttactccggccctccgggcattctgggccacctccagcgtatcgcttaaaagcatctcatggccgccagcctgaagaagcatgggcggcaggcccctgaaatccccgaatacaggcgacatataaggatccctgggatcagcgccgctgatgtatgaggaattgtaaagcatactctcccgtgaattgccaaagagaggatcattttcaaaattaaattcataactgtcaccgctgcatgtcaaatcggcccagggggacatgagcaccagcccggcgggctgaggcatcccatggtccctgaggtaaagacacagggccagggccaggccgcctcctgcggaatcaccggcaaccaccacctggcccggcctgtagtgtttttccttaaccagccactggtaggcgtgaatcacatcctccagggccgccggatacgggtgttccggcgccaccctgtaatccacggtcagcacgtccccgccgtagctgagacggctgtagcgcacggaaaacttacggtaaatattcttcatggggcctatatatccgcctccgtgaagctgaagcaccaccctgccggtgaccactccctccggcttaagatattccattttaaagggttccctgtcaataatttcatactcgtagccagatgggcatacccaggccggttccacgggatttttcctgaattcccctgtctggatgggttttcccagggacgtttccatgatgtcgtgaatcatatcccgcaccagcgccccccgtatactcacatttttattacgcatgcttatctgtatcctctctgtaaatgcagggtccctccgttatcacagatgaaaccgtctgatgagttcgttcttaaaccttctgtcccccaggaatatggtcaaagccaggattcccacggtcagtattactgttataattgccatggcagggtgggtgaccagccctgcggcccacaaaatcagcgggataaagctgaaaaccgtaatggcgatctggtacatgaaatagctctgccagttcaaacggttcacaacaatgaggaacaccacggccgcgtccgcaaacagtatggttcccggcacagcatagttgacggaccagccttcaaatcccaggacccggtctatcatcacaagcagaatctgcatgccaatggtttctatcagcagtgattttcccagattggcatggcgcaggatggaataccggagggtcagacccacataggcgatacccggtatggcaatgccggaccaccagagcccgtcataggtaacgatattcaccaggcccagaaacagggccaccgcagccaatacaccgtagcatacgagtactagttttttccatatgctctcgtcatgctgaatcaccggataattccccttatccgcctccggcatgataacgccgttgctctccagctccacgggaatgccgtctgccctcaggcggccgaaaaaacattcctccagcctggaatcctggaataccttggtgaaggtgatgacggtcctgtggccgaaggaacacacgccgcatttggccggctggcgctttgacaccccaatcagcatgcggaacccttcaatgtcatcctggtactcccggtccatggagataagaccgatatttgataaggtaatggtatgggccctgtcattgcgccggaagatgaagcccagagccagccacttgacaaacagcggaaggatgcggacataccatttcttctcatttgagacattgtaggaaatggtctcctccagtttttccttcactatcttctcgtccatctgcctgcataccgatgcgagaatttcctcaaattcatccctgccctgtcccggttcatggtcaatggctgtcaccgcgaaaaagttggaggctgtgtcggagccgaaaaaggccctcaggttaatgggaaggttcacaccgatatggcgtcccttccggccttcctcctcatatactctggaaatggaccagatcaggcaggcggtcaggtactttgtgatactgacccccattttacggcttaccgccttaagctcccctgtgtccgcgtacccgtggaccacactctcccctccaaagggaatatatctcccagtaaggcgcagcgccggccgggagctgtagcgtctggtctgcattttccggtaattcttaaggtagctgtcctctgtctgggtggacacgccttctcccggccccgcgccggtcctgcgccctccccgctttaattccaggtatcctgcggtcagttccttcaggaaattcacggcccccatgccgtccgtcaccgcatgaaatacctccagattgattctggttccataatagcttacacggaacaggtagagctggttgctcttggggtcgatatagcggcagggccagcttccctcctgctccacaaagggctggcgtttgttctcctcgaagtaataccagaaaaaacctctcttaagcttcaccttgaacccggcaaaccagggcagtacctcttccagcgcctgtcccagcagtccggggtctatctcttctttcaatgttacggaaatacggaatacattgctcaggttttcattggctatcatgggaaatatcttacccgtgttatccagcctgtgccaccgttttccctggggattctttttcatagcgcccctttctgccggccgtcccgcagatttcctgccggtccggcgcaaactgtattttctgccattatatctctatcatcctgcattcacaactatattatacttaatttttgtctgccccattgtttttgccactgttttagccattatttttgccccgcatggcttcttttggcgtcttttgtttttaccccggatatgatatattggacccatacgcccggacaatggcgggctgctttcaaattccgcaggaaatatcatgattcctcctttatttcacctaaaataggggtataacaacaagaggaggtatccctatgaaaaccatacatacacatgccctggagctttcaggaagcagctatgaggccggccgcctgctgggcagccgtctggcatctgttcccagtcttaagaagcgcctctcaggcggtttccccggcttcggcctgacgcagtttaaccaggccagccaatgttttagccgctggtgtcccgggcttaacgaagagctggccggatttgccgatgccctgggctgcgcccctgagcaggttctctattacggcatgacctggcttacaccgcgctgcagccacctggcccttctgccctccatgactgcctccggtcatcccatgactgccaggaattatgagtttaacgatgaggcagaggattttaccgtcataaaaacctgcatcaagggaaaatatacgcatataggaaccagtgtgctgggaatcggccgtgacgacggcatcaatgaaatgggcctgaccgttacactgagctccagcggttttcctgttggccccctgcctgagatgcgcaggcccgcggttaccggtctgcagttctgggccgtggtccgtaccctgctggaaaactgccgcgatgtaaaggaggcattgtccatgctgaaagacatgcctgtggcatacaacctgaacctgattgtgttggacagagaaggccgctgcgccctggtggaaaccctggacggacgtatggcagtgaaggccattgacagcgactccggggaacaggccctctatgccaccaaccatcctgtgctggaggaactgattccctatgaacccaaagcattcgtccactccatccgccggtatgataacatcaccgccttcctggagcggcacaagaagggcatcactgccgggcagctgaaggatttctttctgactccatatccggagggcctgtcatgcagttactacagccaatttttcggcaccacaaaaaccatggtcctggaccctgtccggggcagtctttccctgtgctggggaggacggcctgaaaacggctggcatgactttaacttctcggatccatttccccaggaaaccgctgccatcgaaatccataaccagacagcggacccatccatctttgcatacaggagcctcgtatgaactacaacaatgccatagaaaaaaccatcctgtttatagaaagccacctgaccgcatccttcaccgtggaggatgcggccagggaggcgggatattcttattaccatttaaaccggcagttctccgccgtcctcggggagagcgtcggcagctatataaagaaacggcgtctgtcccacgcggccagggagctcatctacacggagagacgcatcatcgacattgcgctggaccatggttttgaatccagcgaagccttcagcagggccttcaaggccgtctaccacacaagtccggccggctaccgcaaaaacaggctggatgtcatcataagccagaaaccaaaagcggaccagcacctgctggcccacctgacacaatccttgacggtccgcccccggattgtggagattccccatatcctcaccgccggcctgcgggaccgcaccaccctgcgaaacaaccggattccccagctgtggagccgttttcttgacctcatgccccagattcccggtcagatcccccgcggccgaggctttggcatatgtgaatcctgcggtgagggaaacaccctgtacaccatgaacgatgatttgctgttctccgaggtggtgtccgtggaagtcagctccatgtcggtccttcctcctcccctggtgtataaaaccattccaggcggaaagtacgctgtgttcacccatacaggctccctaaaaagcctgcccctgacctatcagtatatctggggcacctggtccctgaccgcccaggagaagttggacggcagggaggattttgagctgtatgatgaacggttcctgggatttaatcatcctgacagccggattgacatttacattccggtccggtaacccataccagtcccataacccatacagggcatcatctgtatgggcactcttacttttcttcccccctgatgattcgtttcatacgtgccagatcatccatggtcaaaaggccattgtccatgtattcctcatacaccacctgcgtggcctccacaaaggcctgccgctcctccctggaaagggtgtaaatttctgcgttggcccggatattttccattgcctgcacttcattttcatcaatgagacggttattttccttcatcatctcttccgtacattccgccagaatctcctgatactccgaaggcagcgactcgtaccacctggtatttacgtagaagggttccgggtggaactggtaattcacttctgtaaaatacttctggacctcataaaaccgcataccggaggaattgacccacggattttcctgaccgtcaatggcgcctgacttcagggccatatacaggtcgttgtagggaacagtcatgacctcggctcccagggcctccaatgttttattgatggtgtccatgccgttggagcgcatcttaagccctttcaggtcctccggcctgcggatcatccgcacgctgttggaaaactgccggaatccgcccgcatcaccgattcccaatatggtggctccgcttttcagggaatccatgcttatttccctggcaaattcggagtttaccagccgttctgcctgggttctgtcttcgcagagaaagggcagtgaaaatacaagcatcctgggaactatctccagctgtcccccgcgaaatccctgtatggtgccgtcgcagacctgttccagcatagacgcctcgctgcccagctggccggccgggtagatatccacctggattccgccgtctgttttctcctccagcagcttcttaaacagcaggaaggactggtggcgcgggttgtccacaggctgggaatggccaatctgcatggaatatatcttttcaggttttttttccaaaccatccttcccctggccgccttcttttaatactgcatttggcccctgacctgcatccagccccagacgcgcatccgcgccccggcctgcaacggatgccatctcctctccccctctgtcaaaactgctgcagcctcccagcaccagcaccatcagagccgctgtcagaatccctgccctgtatattgttctcattccccgtcattctcctctctgatgccttccgcctgctcatagcggaactttaacggagacataccttccattttcttaaatgtccatgtgaagtaattcggctccgaatatcccaccataccgcttatctgcttgatgctgtaggtctcgtttctcagcagttcctttgccttcttcatccggatctgaatcaggtaatccaccaccgtggttcccatatactgcttgaaaaggcggtttacgtagtatttgctgaacccggcctccgaggcaattgtatccagggtcaggcgtttctggtaatgttcctgtatgaaggaacagatgccctccacctccctgggcatgtccctgtcctgttccgcgccctcctccccgcaccgggtccgggccaccatgtcccccacccgctcccgggctttctcatagctttcctctatctggctgacgtccacaaagggggttccgcttcccatcataaaggcaatctgctgctgtcttaaaatcgaagccaggaattcttccatcctcctgaaaattcccggaagcacatccggctcacggcagaaaacaacagccgtaaccatgtggtttgtctcgctgaacatgacggtcaggtccagataatcaaactccttcctgacagcctgaaacagcttctgcctggcgcatttatccagggagccctgaaggcggatacagaaacagtttccgctgcactcagttctgatgtttttcaaatccagatagtagagcacctcctccggcatattgcccagaaccatatcatgaaccatcttgctctccatcatatccagggtctttaacagctttgtttcacggtactccttctccgcctccgcgtccagctcgtcaatggcccgcatgattacattgataaacgcctcctttttcacaggctttaccataaaatccactgccccaaggcgcagtgcctccactgcatactcaaaatagtcataagcagtggaaaagacggccctgaacctgtaatcctggctctttattttttccagagcctggaggccgttcaggccgggcatgttgatgtccagcacaatgatatccggcctgtccagcatcacccgcttgataacctctgttcccgaagcacattctataacctggtctatatccagggaggattcattgataaagaagcgcagtgcctcccgctccagttcctcgtcatctgcaatcaatattttatacatcttcttctcccctgtgcaggtaaatactgacaatggtgcctgcaccttttttgctcatgattttaaggctgtcatccctgcccgtatataaggaaagcctctgccatatattccagactccaatccgttccggctgtttctccgaaagacgcctcctgatcttctccaggcgttccttttccatacccattccattgtcgcaaatccgtatccttatataatttcccgtctttctgacatccagaataagggttcccccttcttccttgggctccaggccatggattaccgcattttccacaaggggctgcagggtgaacctgggaagcgtcacagcctgttccagcttcctgtcatgcctgacatccacgttcagcctggatgaaaaacgcattttctggatcttcaggtattcctctgtaattcccagctcctctcccaaaagggccggcatctgagcgtccgccaggttatagcgcagcagcactgacaatgaatccagcatggtcagtgcctgttcccggcgccccagcatgacggtcctgttgatgctgtttaaggtattaaagagaaaatggggattaatctggctttgaagcgcaaggaaacgggcctggctcagcagcttttcatactcctcatttttgcgctgttccaccagaagctgcttttcgctctctattttttccttcaggctgaaggccatatggttaaatgcccgcgagagcatgctcactgtattttccccggagctctccttaacatgcgcgtccagatttcccctgccgatctcctccacctgttttttaagctcatttaagggccgcgtcaccctcacgaatatataactggctgacgccgcaatgaggacacaggcagctgccacggctcccatgttgaatgcggtcatcaccttccgtctgtaggtcagctcccggttgctgtccacactggactccagcgcatactggagcagttcattggtgtatttctccaggtaaccgccgatggtctggctgtagtaaaagctgtcataatacctgtaatcgctgccgttgtacagaaaggaggcattgcagcattcactgtagtatgactcaaaggactggtcaatcccccgcagaagataccaggattcctcattggtgctttctgtatacaggatatctatgacagacctggctttttcataggtatcattaaactcagccagggtggtgcggtttcccgtcttcatgtactcctcaaacaggatgccgctctggaggaaatggtttttcagctccaggatggagtagtactggtcgatttccttttgatatctggcattaaactggttaaacagggagtggttgtaaatggaaaatgagagaaacagtatcagcatcagaagcagcaccgcattgatttgggcgcccactgaaaaacagaactgtttccaccaggatgttagtttcttcatctgaacgctccttcgctgaagctgacctccggttcctccgtaagcgtttccacccaaacctgatggaattgctccatgctctgcttctggtattggtacgtactttgcgcgcacttttccacggcctccctgtcctccttggagagcgaggtcaggttttccgtgttaatgatcatcacatccggaaggcaccacgcatcatttttggtgacaaaatgaatatactggtcgtaattattgcatataaattcagaaaatgaggactcagccccgtcgatattgcctgatatcagtgatttgtatgtgttggtattgacggagcctgccagctcgattcccatatcccggaaaatctccgccatcagagcggactcgctgctctcaatcttcttgccctccaaatcctttttatccaggaacgttgagtctgtgccgtagaagcaccgaaaatcagggtaataccagaccagtggcgtgatgcggtccatctggcattcgtccctcagggtttcctcattgctgtgtatccactctgtctgtgcgtctccgcctgcaaagttggaagggacaaagtatttgcggatggattccacctcctccgacagctccaggacattgacgcgggccatggcgataccgccgaactttacctgttcaatgatttccgtgggggttcccaggcttccgttatagtaaatcttgaccgttaccctgccctgggtttcacggttcaccatttccgcaaaatacgccatggcccgggcggagggatgattctccggcatggtttccgccagcctcaggattacggcctggctccggggaagggacggactctcctgaccgccgcctaacgcgcagccggtaagaagaacggacgcagccataagaaccgctgccagggcctttgtcagggctgctgcctgcgcgggaatacgtggatgaatgtttaacgtcacctgagaccttcctttctggaaaaataatttttgcggacattgtatcataactctcttctttccacaacaccaaataccctcaaccgaagctgagggatattggatgccatatgattttattttacaagccccagtacattagggatggtcatggaaatggccggcacataggtcaccagtaacagtatggccgctgtcactgcaaaatatggaagaagtgtcttgaatacttcctcaattttcacatttgccaccttgcagcctgtaaacaggataggtcctaccggcggcgtgattgtaccgatgcacaggttgaatacaatcatgattccgaaatggatggggtgcataccaaagctggtgcaaatcggaaggaagataggtgtaaatataaggattgccggggtcgggtccatgaaggttcccaccaccagaagcagcaggttcataatcagaagaatggcaatcttgctgttggtaagtcccaaaagtacatccgcaataatggcaggtatattggtaaagctcataatccagctcatgatggacgatacgccaatcatgaatattacaattgcggtcatctttacgctgtctaacagaatctttcttaaatcccttatcttaatgctgcggtagataaaactcagcagcagggaatatacaaccgcgatagcagaaccttccgtggccgtaaaagcacctattaaaataccgccaataacaatcacgattaaaagcaggctgggtatggccgcccatacggttttcaacacaatggccagggtgatttcatcccggtttctgtatccgcgtttggatgccataatacccgcaatcaccattactccgattccccataaaaggcctggaagatatcccgccataaacagcgcagagattgacacgctgcccgcaaccgtggagtacacaatcagggtattgctgggaggaatcagcattcccgtgggtgcggatgcaatattgacagccgccatataatcctttgaataaccctctttttcctccagcggcccgatggttccgccgatagccgcggctgccgccacaccggaaccgctgatggctccgaacagcatgttggccaccacattggtctctgccagggctcccggcatcctgccgcttaagatttttgcgcagttcaccagccgtatggcgataccgccgttattcatgatattccccgccagtatgaaaaagggtattgccagcagcgagaaggaattgacgcctgtaaataccttctgtgccgctgtacccatggcattctcaaagggaagcacgaacagcatggcgatggtggaggccagaccgatgctgatactgatgggaattcccaaaaccagcatggtcagcacgcagaccagcataaccagtgctacaagtattgcctgatccataattctatctcctttgttcttagatttctctcagtttttttgccagcttcatctcattgtagacaaaatagaagaggatgaaacatgcgcttacaggcactgccgaatagataattcccatgggaatctgaagcgccgcgtccatctgaatcatttggcttgtaacctgcttatagccgccgaatatcatgacgcctgccgcgaataaggcaaccgtcagttcacccagcatttcaacaaccactcttgtctttggaggcatatggtcacggacaaagccgatattcatatgctcccgcagtccaaacacataggccgaaccatacataaccatccagacaaacatatacttggaaagtgattccgtatatgcgttgggactgttaaagaagtatctcacaacaacctggaaggttaccaggattgtcatgacagccaatagtaccacacatacccattcgataatcctgtccaggattctctttgctgattccatgagtcatgaccccgctttctgctaatccctgttagttggcaaggctgcgaatttcttcgtataatgcctttgcgccctcgctcttcattgtcacattgtcgataacaggctggcatgcttcctggaacggagcgatatccacatcaataaactgggcgccagcttcctctgctgtctttattgcaccctcaaggttttcgtcccacagctggaattcacgctctgtgtattccttgcagagatcctttaaggtctgctggtcctcttcgctcatcccctttaaggtggctgtattcataaccaggagatccggaatcatcagatgacgtgtgtaagagaagtaaggagccacttcatagtgttttaaatctgcataggtaatctcattattttcgccgccgttgattacaccctgctgaatcgcggtataaacctctccctgggccataggtgttcccactccgcccattgcatccagcatagcgatacaggtctgggattccataacgcggatcttgtagccctttaaatcagccggggtctgaatcggcttatctgtataaatgcagcgcgctcctgctgtaaatgccgccataacgctgaaattgttggcttctgtacttgcaaagatatcgtccagggctccgctggtaaatacctttttctgatgctccacactgtcataggcgtaaggaaggcccaacacggcaaaatcaggatttacattttccacaatggagtttgccaccatggccatctggatggtaccgctctgtaccagctcaaaggcatccttctgtgagcccagaagctcgttggggctgatttcaattctatatgcgccgccggttgcctcatagaaagcatcgctcatctcggacaaagccagatactggggatgcttctccgactggttaaaagccagttttaatgtagttgtctttacgtccttttcaggtgccttggcctcgcctgccttggtctctccgcctgcggccggtgctgctgtggttgcggacgcggacgcgcctcccccgcatgcagtcaatgacaacgcggttaccccggccaataccaatgttaatgcctttttcatcataatctttctcctgttctcccctttgggattcttaacgttttctttacaggaaaattataaacttttccgcttcaaattgaactacaaaaaatgggccatgtcctataagaaataagacatggccgcaagatattgatagtgtggaagggcaatattttatagttttaaattttctaagttcaaacggtcctggcctcatcactgtaccagccgttttcctccgtataaatcgcaaaacgctttataatctgggttttcccatgttttctcctcgaacgttgtgtatgatacgacaactgctttaaatgtatccacaccacaatcttcatcaatggcatacccttgggaatcaccataagaactgcctggaaccagattaatattctcaaataatacttccgtcacatatgtggaatcgccatagctcagatgtcccttgattttcacaggaagaccattggcatcccagccaacataggccacaaccgcatcacggatgtcctcctctgaattattctgaattacggcctgaagcatatccggatacagtgacttatatctctcatcctgaaccacatactttgtgctgctcacaaacaccggctgtccggccaaagatgcctccagttcttccgcggatgcattttccactcttgtccctgacggagcctctgactttgcaaaagtcacatcctgcatctccacttcaattttaatatcatcggaatacttctttccctcataggcctggcggaagctgtctacataaggattcttccatttgtcaccatcaaatgtttcaaatgacagtatgatgggtttaaatgtatccaccttacaggattcattaatggaaaaaccgaaatcctccccaaatgtacttccgcccactaaattgatatcactataatttacttctgcaaaatagtctcctcctgaaaagtccatgttgcccaccagcttaaccggaagatgattgctgtcccaggccacaaaagcaagaaccgcatctttaatgtccgcatccgtgttattctgaatcaccgcattcagcatatccgggtaaagagacttatactgttcatcctgtacaaggtattccgacttaacaaccgaaaccggaaggcctgacagcaactcatcaaattcttctacagacagttcctttacctctttaggaggaactgtagtttcagcctcagtggtttccttttgtgttgtctccttttgcatgtccgctgttccggacgcactctcctgtgccttctccgtgtttgttgcagcggatgtccccgaacctccgcagccccctaaaatcattgcagctgataaaattaccagaaacgattttttcatatgtatactcctccccttttttgtttcattttaacacttattcagggaatcgtccacctaattgtaacgcattggtaactattggtaattatccagctgtttttcagccacttttattaactacagatgctttatacccccactacttatgatacggctcccccgaaataatcctgtaactcctgtaaacctgttccaacagcaccacccgcatcagctgatgcggaaatgtcatcttagaaaagctcagggcaaagtccgcccgcttcataacatccccggacaatcccagcgaaccacctatgacaaacacaatatggcctaccccatccactcccagcctctgaatcctgcctgccagctcctcgctggtcagcatcttcccctcaatggccagggcaatgacgtaagccccatctttaatattagaaaggatgcgctgtccttccttttccttaatctgccgctcaatggcctcgccggccccgtccggcgtcttttcatccgctacctggatgatatccagtttacagtagcggctcaggcgcttggcatactccctgatggcatcctcaaaatatcgttccttaatctttccaaccgttacaagggtaatcttcatctgctaaaactccagtatcatatcgtaccacacagccccgccgtgaacggatttggaattgcccatattcacatatccaaaggtttcataatacccaatcagccggtctttacaggtaagaataagtcccctgcgcccctggctcctggcccgttcaatcatggccttcatcagacgggaagccaccccacggtgccggtattcctcaatcacatccaggccgaatatgctctggtaggcgccctgcggctcatggagtgaagtatcctcaaacatctcgtccccaatggtcctcttatttgtgacagcgccattgataaacccgatgattctgtttccatcctcagctaccaaaaagctctgaggaaatacatccagacgctccttcaaattttttctgtctgctgcctccgctgccggaaagcaggctgcctccacctgcaccactgcgtccaaatcagccggtaccgctgtccttatggtaataccatccatcttctgtcctcttttcgtatcctttgctgttcttaagcctttaccctgaaatagtatcccacaccccacttcgtatgtacataccttgggtcgctgggactgggttcgattttctcgcgcagcctcctcacatggacatccacagtacgcacatccccgctgtccatggccttatttccccatacataggtcagaagcgcttccctgctgtataccttgttgggattgcgcaccagaagctccagaaggtcaaattccttggccgtgagattgatttcccgctcgccgataaataccctgcggctctctgtatccatcttaaggtcccctgcgccaatcacgccggattccggctcctcccgcttctgacgtttgctcttcccgcttcttcgtatgatggccttgattctggccttgacctccagtatgttgaagggcttgctgatataatcatcggcgccgtactccagccccagaatcttatccatgtcgccgcccttggccgtcagcataatgataggcatatccgaaaactcacgtatggcctggcacacctcataaccgtcatacttgggcagcatcacatccagaagcacaatatcatattctgtctttttggccagttcaatggcctcctcgccgtcatatgcacagtccacttccatcccgtcctgttccagactgaagcggattccttttacaattaatttctcatcgtcaaccactaatactcttgccatgttccattccccttatctattattaaacggcggcccgataaccaaggccgcctgccgtcatttacactgtaatactgtccttaatcttttcaaacgcagcatccttgataccggatacattcataatatcctcaatggacttaaatccgccaaactcctggcggtaatggataatgtcatctgccctggacgctccgattcccctgagggtcatcagttcttccctggaagccgtgttaagattcactctggcctttgaaccgccttcgccgctccctgtcctgccggacgtctgaacgcctgctgttccgccgcccatggatatacctgactgggtcagcccccgggccttccactcctctgcctgatcacggtccggcacctgtatcttcatgccgtcctctaacacctgggccagattcagataatccggcactgctgcttctgagaatcctcccgccgcctcaatggcctcatatacccggctgcctgcgggaagtccatatacgcccggcgtactcaccaggccgcatacatgaatatataccagaggcatatcttccccggacaatgtatcctcccggggcagcgtatcttccccggaccggctgccttcctggggcagcatgccatcctgtcccggcgtaccttcctgtcccggcatgccatcctgtcccggcacactgtcctgtacacgcagatgctctccatccgcgtccccggacatggccccgccttccggttcgtcccggtaccgcgggccttcaatccccccacgttcctcaacagcgaaaccactgtcagactccaatgccataaccatattttccggtccagtatcccggttcttcacactgcagctatagcatatgcctgcagccaacatacatatgacaatcactgccagttttattactttgaaagatgtaagtttcatcttgggcggtatccctccttccagagagcaccgtcccagcctgatactcctattctatcggaaaccccctgcaaatacaagcgttaatttccaaattttatctttcaaaaattacaattccgcctatggcaatgaccgccccgattatcttgttccacgcaaaaggggctttctccacgccaaacagcccgaacagctcaatggcataagctatgattatctgagagaccacaatcagaagagccgccttggccggtcccaggcttcccatgctccggataaccgtgtaggtgataagggctcccatgataccgcccacaagcacatatttgggcgtaacctgcatgaggccggccacaggctccctgcctgtaaacagccatatgaccaaacaggtaataaaggccgtaagctgtacccagcccgcagccacccagacgctggtctgctttgtcacttccgtgttaaatacgccctgtatgctcattaaggcgcctgacagcaatgctatgataaatcccatgtattattttcctgcctttccattcattttaccgttatcttagcattcccacaggtttctattttattctggcattctctctgcatatgatgtataatcgttccgtcaggaggcacagctatgctatcatttataaaaacattattacaggccagcgcctggcccatccagacacctgagccatactccgcctttcacatcctgctctgcgccgccggcataccgcttgccgtctttctggcccggcgcctggcacgcaccggtacgcacccttgcggtgtgctgtttatctgcggcctggttttagctgtcagtgaactgtataaacagggcttcctatattttgtcgcaggccagggccggtacaactggtggtattttcccttccagctgtgcagcgtccccatgtacctgtgtctgattcttccgttattcaagcatacgccccattgccggacggaaaaatgcatttgcaccttcatgcaggattttgcacttttgggaggcgtcatggccctggctgaacccagcggcctcatgcacccctatctgcttttgaccctccatgggttcctgtggcatttcatgctcatcttcattggcctgtactgcgccatgaccggactggggggcagaaccccaggcgactttgtatccatgctccctctgtttttggcctgcgtatgcatagccacgttcataaatgtggcttcccatccctacggcaatgccgatatgttttatatcagcccctattatccaaacggacagattgttttccaccagattgccctcaccataggtacggccgcaggaaaccttctgtacctggcagccatggttctgggaggctttatctgccacctgtccctgggccggctgtttccccggtaaccgttctgacggtttccgccgcggcccgcctccagccatccattcagacattccgattttcagtcatgcagattttcagtcaatcaaaaagccgcctttgtccggtatccggccggacccaaggcggcttcttccatgccctctttccttaatacgttccctttttcaaaagtttgcgcagataggcaaaggtggcttcctccccctggtccttcagcatgtggagaagcttctccaaaagcgctctggtcctgggatggatggtgatgtaattctttgtatactcgtaatattctaacggggccgcgctggtgtaggctttgcccttatacacttcgcaggcagctatccggtcgcagaccatctcggccacataccgcagaggcatcttatttcccaccaggccctcctccttatggttggaaatgtcaatccaatactcataatggtgcttgttcctgcccttatggtgaagccaggccctggaataccccacggtctcacgctccgctgcattggggctgcggtttccctgataataccttaccccggtccagaactcctccggactgtacttggagagatcatgggtaagtccctgccagtacaggccaatctgaaagcaatgcttcctgaccaggtttctgtgccttgtaatggtagaaaaatggttccatatattacagattttcattcaaatcccttctttacacattaatacgcatggcgcactgcattgaaatatgctctagtatatcataaatttcgcctttttggctgtatttcttcatattttaacctttgaacaacagaatctgaggtttatataaattgtttatacttaatgcccaaaaacgtttgacacttttcaacatttatgatatccttaggacagttgcgaaatagtttgcaacatatcacatttttttattttttatattttttggaggtatcgtaatgaaaggtacagttaagtggttcaacaaccagaagggttacggatttatttccgacgagcagggaaacgatgtattcgttcactactcaggtctgaacatggatggcttcaagtccttagatgagggcgcagaagttgagttcgatgtagtaaacggagctaagggtcctcaggctacaaacgtaaccaaattataatcaatgaacaacagtgtacctttttcaaacatatatcatcactgatagaggttgaagtaagttatatctgatttcaaatgattacaagtaagagccagtcctgggactggctcttattgttattttgatttttccagcatatccttcagttcatccacggaaaacgtgtaattcttattgcagaaatggcagttcacctcaataggcttgccgtcctctatcatttcccctatatcctttctgcccacgctgatcaatgccttctccacccggtcctttgtacagttgcagtaaaatgcagccggaagccttccgccgatttccaggccgaattccccaagcacatactccagtatcatctccggcgtgttgcccacgtccagcagggtggtaatggacgatattcccttcagcttgttctccagtctgccgatgatatcctcggaagcccccggcatcagctgaatgatgaagcccccggactgacgcaccgtgttgtccttattcatcaggacccccagcgccaccgaggacggagtctgttcagaggtggcataataatatgtcaggtcctccgcaatctctcctgttaccaaaatggtctgcccaacatacggctccttaagcccgatgtccttgatgacacttaagacgcccacgcccagcgctccgcccacatccagttttcccttttcattaggaggaagcatcaccatgggattaaacgcatatcccttcacattacctctggaatccgctgtcacggtcaggcctccgatgggtccgtccccctgtatcttaagggtgagaaggtcattttcccccttcatgtcacagcccatcatcacaccggccgtcagcagcctgcccagggcagccgttgccaccggactggtattatgggatattctggcctgttccaccaggtccctggtggtggcggcaaaggccctgatctgcccctgtgccgcagttgctctgattacataatctgccatatgtttcactcctcgtctttcattgtctttccctgttccctcatgattacatagatgcgttcgctgtcttcccgcaccggattgcgggtgcacgcatcgtaagcagccacaaactccataccggcctccaaggctgcccgtttcacctcatccaggctgtaggccttctggaaatgtgtctcctcatacttgcggtacagctggccctcacggataaacagggtaaggtcatactcgtttattcctgaactttcatcgtagaaattgtcccagataaagctgctctcctccctggcctccgcaaaggtgttatctgccagcaattcccggtatttatactctgtgttcaggtcaaatataaataccccccttgggtccagataattattaaccagccggaacacctgcaccaaatcccggtactccatcatatagttcatggaatcgcatatgctgacaactgcccgcaccgtgccgtaaagctcaaactcccgcatgtcctgcaggagataaagaatgtcctgacccgaagccgcccgcttatccattgccatctgaagcatttccccggaattatcaatcccaatcatatcatacccggcctctgccagaagcccggtaaggcttcccgtgccgcagcccaggtccagtaccagaccacgctccactccctgctcccggagcagtcctgttacataggaacaccactcctcatagggcacattatcctggaaaatatcgtagacctccgcaaaactgctgtaagcttccatgtcctcatccttcccaacggcgccgcgtctcattcccgcagccatcgccaaatcatcaaactacaaaagcgcctgtccggaacagttccgggcaggcgggtaaaatcaggggctttatgcgttctttccgcagcacttcttatatttcttgccgcttccgcatggacagggatcatttgggaaaatcttcttgcccttgcgcacggtaccggacgccttctgggacttatacagttccttgcgcttatccggtgtaagaatctcgtcccactggggaagctcatacagccagttagccttcgcctctaccatattgtagtacagcttctccgggtcaatctcaattttaacctcagtatcctcttccatggtatcaatggggttctcatagcccttcaggctctcattgattccatccaggaaaccggtcataataaggatttccgtattgtacttctctgccaggtcctttacagtgcccgtgataacctctgttgggttagaaagaatctgctcatagattcccttctcaatctgaaaatatccagcccacaattcttctttctttttatcatccaggccgtcgccgtaagccagatttctccatgtctctaacagtgccatagtaaaaccatccttcttgtattatttatgttccaggggcttcctgtccagggcgccatgcctctttctgtctgccggaccgttctgctgcctgtccatggccgcccataacccttagtatataacaaaacataagatttttcaaacatattttatttatacagctaaatacagccaaataaacctaaaacctgaggcatttcccatacatcccagtcctctgtttttgtctcccctgcagatcaagggtattttttctgtttttctgcaaataatatacctgaatccaattcaattcaaaaggaggctttaccatgaaagtaaacggaaaaaacgagagcatcaaatgtaccatcaagaattgtgcttacaatgcacagtccgaggattactgcacccttgacgccatcaaggtcggaactcatgaaatgaacccaaccaagaaggaatgtacagattgcgagtcttttgtaaataaggctcagtaattccattctcagggactgtgtccgggcaggctatattgctgtctggcacagtctcttttttcttttatttatcagataataacacattatccacattcttttccacaactttgtggataactcgacaaattcgttgattcatccgcatgtctgtcgaaaacagtcaaaaagaaaagcacccgcagtgatataatatcatcaatcacagcggatgcttcctatattaacatggttttctctttgtatttggtcccatcccttcccgcctggaattatgggtctggttctggttttccggctttaccttttccgtaatgctgttaaacatttcatttgacttttttctggcctgcttttcttcttcatatctgtccatatccgtctcccatccgccgcctgcatccgcgggtgcatacacggctgtgatttctctgacaacagtatgtcctgaaaagaagaaaaatatgtaaaaagttctaaacttaacttgtatttttttccaaccgtgctataatcgaatcaatggggacatagctcagctgggagagcgctgcgttcgcaacgcagagaccgcgggttcgaatcccgttgtctccattttatatggtgtgccaaaaccctttgcacagaaaggattttggcttttttattttatatccccctataatcccatatacatcccaaagaaaacctgtaacacataaaaatcatccgtaaaatgaatgaaaccaggaggaactacataatgaatgatgaaatctttatgaaagaagccatacgcctgtcccagctggctgtcagccatggaaacgaaccctttggagcagtgctggtcaaggacggcgaaattatcttcagcaacgagaaccagatttataccggctccgatcccaccttccacgcagaagccggactgctccggtgtttttgcgcagagacgcatatcacggatttacgcgaatatacactctattccagctgtgaaccctgtttcatgtgctgcggcgcaatggtttggaccaaattggggcggctggtctatggcgccagcgatattgatttgtgcagcatacttcatgagaaaggagccgaatgctgcaaaatcgtctttgagcattccccctggaaaccgcaggttacgtccggggtcctgagggacgatagcctaaagatattgacagcctatttttcaaaaaatacaaaaggctgagacattctctccgctgcctgactccggggttcttagattctaggaaagaaccggctgattccgaatagaccaatacaacgcccggcgtcttgtgcgaaaatggcaggatgggcataaaaccgcctgccaagccgtgcagccttaacccggacagcctctccccgccatcaaaatggaagctgtgccggtgtatactggaccgtaatccatttcagctccgtaaactcgtcaatggaataggaaccgccttctcttcccacgccgctgttcttgactcctccaaaagccacagtggagttatcagaaaccgttgcgttattgatatgcaccataccggcctccatgtcaagagacagggacatggcctttgacaaatcattggtcagaagtgatgaggaaagtccgtattggttgtcattgcaaaggcggacagcgtcctgcgcatccattgccttaatgatggaagtgaccggcccaaagctttcctcatagaatatcctcatatccggtgttacatccttcagcactgtgggctggtaatagtttccctcatgggtcccgccggtcatcagcacggcgcctttggatacagcatcctgaatctggctgtcaatgatctggcactgctcctgtttaatgagaggcccgatgatggtatccttctggtgcggatcccctaccttcatggttctggcataggcagcaaacgcttcacagaaccggtcgtataccggctcctccacaatcagcctggaagtacacatgcatatctgtccctgatggaaaaatgctccgaatcccgcaatcctgacagcctgttccacgtcaaaatcctttaaaaggataagaggattcttgccgcccatttccagagaatatttcttaaaaagagcggacgctttagcggcaatccccctgccaacagcagtagatccggtaaatgccaccatacggatgcgttcatcttcaataagcttgtttccaacctcctcaccggaaccaggaaccagattgaacacaccctttggaattcctgccccgtccagggccttggctatcattacaccggaaacaggcgttgcgctggctggtttgagcacaaaggtattgcctgctgccagggcaaaggccacctttttaagagccaataacaatgggaaattaaagggagcaatccctgcaaccacccccaggggaagtcttcggatcatggatatttcccccgcctcctgctgctggacctggccgaatacccgccggcactcaccggctgccgttctgagtatatccactgcaaatccagcttcaaagtacgcctttccaaaggcagaaccgctttcccccatcagcacatccgccacctcatccatgtgctcctgcatccagtcagctgccttcagaagaatctgctccttttgggcggccggtgtgtctgcccacggtctccatgccctttgggcagctgcaatggcctcctccacttctgccccgcctgcaaaatgcaccctggcaaacacagaatcatcagccggattcttatcctcagccacatatcctgtcacagtgtccttccattccccgtttatgtataattgatattccattctcaatgcctcctatctcatcttcagcaaggctttaatagctttcccgctgtgggaagcctcaaaggcctcattaatctcatcaaattcaaacacgcgaatcaatttgtcaaaggggaactttccctgcttgtagtatgaaatcaactgagggataaacagtttgggatttgaatccccttccacaatgcctataagggactttccctcgcccatcagctcctcctggacctgtatggtcagctctcccgtcacacccaataccacggccgtccccaggaatttcacacaggccagtgcctttttcacaaagtcaggtacgccgctggtatcaatagcataatccgctccgccttccgtaattttcttgatttcacttacaatacagtcacattttttccggttgatggtatgggtggctcccagttcttttgccaggacaaggctctcttcatttccgcccactgcaatgatatttttacagggacacagatgggctgccatgatggcactcatgccaactgtaccgcagccaaacaccaccaggcttgatccggccgtgggtttgagccggttcaggacagcgcccgctcctgtctggattccgcatcccaatggtcccaggatatccagttccaaatcctcatccactttaatgatgctgttcttatggacaacggaataggttgcaaaggaggattgtccgaaaaaggatgaaatttcccggccatccttggacagacgcttggtgccgtcgctcatgacaccgccaaaattaatggcattaaaattctcgcaggcatagggcctgcccgccagacagttcttacaatgtccgcagtatccgaaggaaaataccacatgatcccccttctgaaactccgtcactccctctcccaccttctcaacaataccgcatccctcatggcccaagacggccgggagcggtaccggaatcatctgatgctgtgccacctcatccgtgtggcatacaccgctggccgctatctttaccatcacttccccctcacggggatcctgcaggtccaattcctcaaactggaagggcttacctttctctctcacaactgctgctgttatcttcatctgttaaacctccctttctctgatttattgtaccatcatatcactaatcgcgataacttggaacaatagtttgtattttaacatatttactaatattttaacgataaatcaaaatattttttacaatttctgactttattcaactatagtcatacatttatttacattcaggtaattcatctgtccggcaggatttcacacagccagcaggagttcagccataaaacagcttattacgaaaatatattttctgaaatgcaaaaaaaaccagacgtcacagtctggccattatatctctaaacctggtatattcggatttcctaccatgcctcaggcggatccgttacctggcttttactgtactcgaatattaccttgttaaaatccttcccacggtccagattatatttactgtaatagagccacacagtcagtttgtcgggtgttccattcatcgcattatgctgggaaacaataccctgaacctcctggtcaatccgccagggtttatatacaatgacaaacaggtccgtttctctgacattcaaaccgctatatgagaataccttatagattctgtaatcaggcagccgaatataacaggccgccaggagcaataccataaacaggcctgcggcggccatatatttccatatttttctcatttctccccctccattacttatagaacggagaagtgtataataattccctttgttcggtccgtatgcttgtattttttgatttatttccgacacttataatatcaggagaactattacgataaagcaatacacaatatgaaatacggcccgaagcagtttacaattttgttctcatacagtagggctttatggtacattttatcgtttattttttctgtttaattttactgttcaggattttactgttcattacaagaattgcttgccatcctccctgcctatatgatataattaatctcgttggagacatagctcagctgggagagcatctgcttgacgtgtagagggtcgcaggttcgagtcctgttgtctccactggatatttgtgccggaacctttgtttttacagggtcttggcacattttttattatactactttgaattttgaagacaattgaagacaattataaattcaatctattataattcacacaaattgaaggagtgatgtaaatacatggataaacttgcagatattcttaaaccatttattgaaaagtacatggtatcatctgtaatttctatagctggagctattgtaacgatattatatatcccagataatcattgggcgttactcaaattaggtaaaacacctttaatggttttagccttttgcatttattttttaatcgttctatgtgttaaaaaaattggcataatcacacataatatgtttatcaggttctatagaagaagatatacgcagcttactaaagaacagcaaaataaggatactatcaatgctataaataaatatatcgatagtctttcgcccgatgataaagacactttactaacttttattcataatggcaataaaacactgatagattgtgaaaaatattactttcaaacaaacatatattctaattcaaactttatgttatcttctaattactacggtgagctttcaactcttgatttggataaatattggatctctccttcattagtaaatgatttagataaaggtatgcgacctgtaggagtactcaaacagtataagcttaatgatgattttttcaatgacttaactatattatataaaatgcaaggtaaaattggtaatttctaaagcacattcaacctcaataaagcaatcatcttcctactttcttatgactaactattacatccatcttatagacataaaagagacaaccacccacaaagggattggacctcagaaaaaaacagaaactccaccctctcaactagccaagtatacaagggtggtttttctatgcctgtttccaggactttaaagaaaaacgttacttacgattattaaaaataaaggtaagcaatgattaacagcccaaaagccataagagcatgaaaacagaatacattattctataaattttacaatactggccccattattatagttaactatacatcctataatatgccttttctaaatctttcggttcattttctaccctatatttagacaattcagattccatatcaaaaataatagcttttagctctttcttttttgacaacgcaaatacacctacggattttaattcattatacttttccacaatagcttcatttcgcttcttaatctcgctattaaatacagcataagcggcatcacattgtttccttaatcctctcgctttttctatatatgataatacagaggaaataatacatctttttatttcgagattaattttacttatttctgcctcactactattcgttaaccttacatcatcaattgagagcaaattcatatcagcaaattttataaactgcttttcatttacaaacgaatccatgaagcaggtaaccttgttttcaacatcatcaatactagtattaatgatagtatccatattctggtttatattatctcgaatccatttatctaattctttcatgttgtatgtcaaaacttttgctattgaatagttcttttttattatttccagttcattactatataaagaatataaaatatctatttcactgcatcttttgtagtctgctaatattttaatggcatttgatatagtatcactatgtaaacttttcttacaataatcttctaacacttcaataagtacgctatcttgataaaactcctttgctgttttgaatgtatctatatcacataatcccacttcaagaacttttgcatatatatctggattatatgggcaacacttaaatgcctctattaaaacaggttttttatcatctactaatagtatattattgagtaattcagaagaacgcttcatatcatatgaaactacttttgaataatcatacatagaatgtgtttgtaattttttcaaataatatgtcataagttcactaacatacatcccaaatgacgctgctatttccggataaacttttgttgcaaacagttcagtatattttctttcttcttccgactctgttcttctactcaaatcttccatagccatctcataatctttatcagcctttgcacactgccttttcacagtgctcgcttcataagcggctaatgtagcatgcgcaagtatgctattagaccagatggaaataccagcacctgtaacctgagaatatgctgaagtttgggcatcctcaaacccactaagatatgattgcatatgttcaattaagatctgtttggctccatccatcattgccttatatgtttcctcataatgaataaagcctttgttagaattaataatgtcggtctctgtcacatcaaaaataccattttgggacaacatagtaataactttctttccttcacatatcatcgcttcttttaatctgctctcaatatcacccatcgcatcagatccaccctgatcataaggcttcttcttcatcgtacaaataagctctttttgtaatctattattaattttttcaaattcattacaataaataacatattgttttaattcttctggaaaagtatagctttcattcaaaaacctaaccattatatctgacatatgattttatccctccaaacatttatttttacattatatcgcacttttatatcactttctatattatttatcagaaatatagcatacaatcttctaattaaatccttttatgtgtttatagagggggtatactttacatgcaaaattaaaaagtacctgtccttattccactatagatgaaaatggcaaaaaaataaaggaacctttgctccagattcctttaattgatataagcaatgagaaaaaagggactaagccgtagcctaatccctaattcttctgtctctttaagcattccaaaatctataagttatgtcaacatatgaactaccatctttgtagaacatcctttgatttgttcccgatttagttaaaggacctgctttttctatataggcacctgtcttaatataatcaaaaacactcatccactcttctatccttacattacgcccacaatacaaacaattctttaaacctctatcttgtacgtacttggcatatgagataagttcatctctatcttgtattgtcccctcacccataaatgcaacacaagatatataatctatataaagttcaacaatatgataaaacttatccttcagacattccccatacttggaatcacgtaattctggataatgacaattcttacaatgatttaaacaaccagttaaatagaaacacagtgttttgtgtcctggcactccttccacacttacacctgcatcatgaaaaagcagcaaatttttatctcctcagagtatagttaatatgttattttgtaatcaaaaataaaaccagcataaaggtgaatcactatccgatatactaaaaattttacactactttttgacacttccatctgtaaatacaatttgggtgacagtatattcaaactttaaatccttataatctgtattataatattgcatgtcaatgtttataaacttatttacatcatatgtcatatcatcaaaaaccactttttcgccagatggtatagtttttccagtaaagtcacatccaagtgtcagtatctctttaccaaataaatcatttatttttaaatctccctcaacaccctgtatgtccttctctgtattatttgttacttcaaataccgttgtgcagtacatttgaccatatttcccagtactggtatttttatctgtcacactaacagttacatcctcttgtcgtatctccacctctgcttttgattcttctattgaggcttgtaatgtttttaacttctctttttcagaatcgagttctatggataacgactcaatagcagatgacatgctttctttttcatatgataaactttccacttgggctttcaatgtttcattctgtgacatcaggtcatttgaattaccacatcctgcaagcataatgctaataagtcctactaatgatatgtagcttttcctcatcttcttccccctagaataattaataagtatatattaaccgataatctttgcttagacaatagaaaaaatattctggttaatacggttccactttcaccttcagcaatatatcataaatataatccggtataacatttacacctaaattatctgctgccactttgatatattatctgtatactatacttacaactccaatatttttttggaatacctatcgcaagaccatatgtgtatcaaatgtccttctgtctccagatataatatctttcaatatcatacccaccacgtcagtagcatcaattgtaagcgtctctgtagatttagatattctaaaatcaaaatatattccactcaattttatatattgatttatatgtcctgtctttatataaactggttcacctgttttctcaaaatcaatagcaactcgttcttccttctctattccttttcctctagctctattatacaaaaacttgtccattggaattttctcaaaatcacgattaaaaagttgaaagtttagttcgcctttgtaaacacctattttcaaatcctctttgtttatttcaggaagattgacatctatccactgttcatccattacaatgtgaatgttattataaataggtaattccattgttatatgcagaacaattgtttttaaacgtcctttccagtcctcatcttttggttcacgtaattcataaatattaatgccatgcattttagcataatctactgcaccactttgatatccacttttgcatacatatattccagctgtcccggcaggcagatcatcaagtatagctttaaatgccagcatttcttttagtggcacttttgatttccaatcttttgcttgaactatatttctatatatgattccacccatttcaaattcccaataaacatctatttggtgcatagcgatttttccttttatatcaatatcatgttttacttcgatattctgaaaaacttttagatcagaattcacaatttgctgaaatactatttgcgccatcttttcatattctaaacctgtattctttttaggcatactatatacctccatcatcctgctctctcttttaaagtataccttctgtagattaatatttcaaacaaaaataaaggcataccagataatcactatccgatatgcctattaatcaatccgtaacctcaatcttccaattcatcatagcctcatataccttatgtggtatcatacccttatattgctctgccatgtccttaatcaaatcctctttgtattctttatacctcgcaaacgctgcatcagccgtatcaaaagttccaagttttacactcatacccccaaacgctacacaagcacgatattttcttttatcgctatccagaaaaacgcctataggacattcaccacgattgcttttgccattcaaaaatagtgtattgattatatgaggaactaatacacaagtctccggactatagatcgtattacctttaaaaaggatatccttatccagatccaacggttcatctccgtatttattcccttcataccatagtctataattgcagaagttgtgccattcctcacatacagtacaatttttatattgaggttgtcttgcgtgaaatttttcgttgtaacatcggttcatcatatcatgccaacgtaaatatgtttctgatttgcagttaacatcttcactcccacgatatccgaccttgcacataacaggccgcatagcttttttactccaatcatcgggtttaaatttcacttcgtttatgacacttcggataaagttttctgaatcatttccagttttaaggaagtgacttttaacaaccctatactgttccctattcagaggatagaggttcctataataattatcttctctatttaagccactatgccatatatacacattgttgctcttgtcagggtttactataaattcatcgataacagcttttgctgcatataggtagcttttactatatttccatcccccgtttgaatactcatctttcataagacagtaaaacagatttccattcttatcatgacttccaagcttgaggctatattgaccgtctgaatatccaattatcctgccataattggatagccatgcatttttatagtccatgagcttcacgaatatttcatctgttccaattgggattattttagtcttggacaagtcaagaattctttctggtttaattttcttatattgaaaatctatcagtaattccaagtggtcagaaaatgtaattctattcctttcctctaaatgtttacgttggttcttatactcacattctttacactgacctaaataatatgggttatggaattgtccctttaccagtctgaatttatctattggcagttctctattgcatttattacatattttggtttcttccacttctgtaaatctccttatttctttgcattaaataagacagcacgatttctcatactgcctttaaattagcgcttgacaacgttaggggtaaaagggtaggggtaataacacagatatattagttatctcccctacccttttacctcttccccccattttggagccgtcaaaaccgatgcaaaccatttaaaggtatgctaaatttagcatatctatggtaagtttgattcgtcagaattgacggaccaaatctatttcaatagtattggaattttgtcaaatatggaatgaacccagtttatagaatcactccacaatttgggggaacgaaatttagtttaccaactcacccccaattgggttttagtcttgtaaataccacatatatacttattgattttttctgtgaaatcttgcgtagaattacgcgatagatttattcttgaacttctgatactggttttattttacttccagccagttaggaatagcttaatcatagtaaagttaatcctcttggttatcttccacatcaaataacgctctttccaattccgaccctataaccattttcacctttatatgtggtgggactactactttctcccgtgtctttggattatatcttatacactcttccttatactctggcttcaatgttaataatccatggatgtgaaaccgttctccatccaacaatgtctccgtcaatacatccttaaaagcttccataagtttataggttgctttcttcgtcagcccggatttatgcgcaatcctcgttacaatatcttctttacctgccattgttcaatcctcccttaatgtttaattttgatctctttggacaccatacaggacttgtctttggtggattatccacgccaacatatcccatatcattttctctgtcctcatggtcacagtagtaattcttatacataaagtcaacacatttcaaatattcacactcgctgcaatgcggtattctattagccatagctatatcctccttgatttcatccaagcatacacttaagtgcttatttacaatctgccccagctcatcaatattcatttctccataaaggcatgatagtcctgccatattcttttcatcaataaccactactctgtcttttaattccatatgtaatttcctcccaatattatccttttacatttaatcctttggccttcatatattgaatcgcctctttaagcaacgaaccattatcaactgtatgcttcatggtatcattccacacatggggcttatggcttactgataatccaccatgcaatccctcattcgcccaggtagccacttggaaccctgtagcatttacataattatccatagcgtcatagtcaatatagatgtaagccacatacttattcccttgcatccttgcttctgttttcactgccgaatatagaaaatctcttgttctccgatagctcgatggtgtccagcctgtatagtagtcctgtaaataaaagttcagtgtctcatataccttgtctgccatctgattaaccatactctgcataaccggagccagggcagaggccagttggtccatgttacttatgcttcttgccattccttaccttcctttccggagcttcgataactattacagatttcgcattataatcgctcctgccattgatgaacactttaaagtgcacatagtacccacattcaatatgttctccatacagatttgacttgtgtatgaaatatgtattgccatcctcaccacgtatgaatccataccccttgtcgctaaaatactttgttacctttccgtacatacaattacctccatttttaattttcgatatcatatgaaactaccatttcaaatcgtgctcctacaatgcccctgtaacgcaccagaatggacgagaacgggtttaaatgcgttgtgtgttccgttcttaggttcatatacgagtgctgtacatgggcgtttaattagtttttggcgcactaaaataagcccgtgaatatgcgatgctgctacatactcatggacttatttagatgtccaaatatttgatggtaaataccaaattcggatatgatatttacaaattttagatacagtgttgtctactcctttcctcacttatttttgaagacaaatttgaagacagctaatttcaatatgtccaaaaacaacgtatttacgtactttttaatagaaacaaatgttcgagtcctgttgtctccactggatatttgtgccggaacctttgtttttacagggtcttggcacattttttattattctgaatacaattgctcaaaaagggactaaaccgattggcctaatcccttctctgcaagcagtttttcaattactatcattctcttccccgttccagattccgttcctatccacctaccatccctcagttcccaggccatacgttcataggtactgccatcatgctggttaaaatatctctctttccatatccgtaatctcagcttccgtactctcttctataaaataccgtatctcctccatcacactgtcggcttgggcgctatgcggtacgatagcagccacaccaatgacaatggtctggtgtatatcctgctctcccacctctgccacagccacgttaaatttgttccgcattttagacagcaggcttttaacaaccatgcgtttttctttcaatgaatgaacccagggcgcatggagcttgatttttaatgataatatcatcatttcgtccacctcgtaatcaaatacactacgttacaatttctcatcttttaattatgtcacttccatccactttgtcgtggataattccagaatgaccttacttataaatatccaatcccttcatatttataaataaactcctctctgccacttatccacagccataataccactatatatagataaacacaatatcaatcctgattatcttgtgttttcagtggataatgtggataagtatgttgataaccggtggattgaatgtggatgcaaaccgttttctttttataattcctttttatggttcccttttacggttcctccatccatatttcatttgccgctgttttatttaccattttatttgtgtccccaaaatattgccccatgatttataatgtagtatgattaggatatattatctagtaaactgacctatcaatcacaccacaggaggtattaaaatgaaattcttcaccaaggcactcatcatcctggcggttattctccttatattggctttgggcgacagcatattcaacggtcttttcagcaatgacggttatcgccccgtaacccagcaaatgaaagagatcatgacaggaaccgattaggttcctttttgatatcctgtggctgatattcacaattttcttacaaatcgttcatattttcgctacaggatgctcataggatgctcatatttagcccatatactatatcttgtaagttgatattgctaatcagactttttttcataatacagccggcaggagaaatcctgaccggctcctcccttttttaaggctttttgacctctcctcctcctcccacaccttgtccatccgcggatgagggctccagattcaaacaatatctgacgcctcccccagtttatatctgacaaaaataaaaatattccacctcattgatgataatactcatatttgggttatccagcaaacttcttgtcctgtttataacatttatgagcgacttcttataggttccgctatcagccacctccaccgggttcctgacagcagagacacaatgccctactttccccagttggcagccgcgtatctcaccgcatatcaagctgtgcgttgtcactgtcccggtgacatagactcctgtggagccgtactcctcgtccgcagccatttcccagcatcttcccacaaagtcgtctgtgtaatattttgtatcaatcccaaaaaatgtgataatatactgctctgttgtcatattaatacccgcagccttttacaatatcttattcagacatagcgcattcattgcaggtccacatatcttaaaacagattcagaacagtgataccccatggattcccccttctattcctccctgcctatctgctttatgatttgattgacatacgtgctcagccctgccagcaggattccctgggttatggcggtaaatattgccatgaaaatttcctgcccagaccggcatgtacttgtggcaagcacataaatcccgcatatgacaattcccaggccgccgttgattaaggggatatatctgtccttcaccgcctcactctgcttaatccacatgcccacaaaatacagcacaagagccaccacaattagctccggctttacataatccgttatctgcatacacactttcctcctgttacttgtcttactatcagtatattaagctgaacaggttttgacagtccaaagcccaaaaaagagaagccctacggctcctcttccattttcccataaacctcagtttctgctttctgtctcagtgtgttaggccccagatactcgccatcgtgccatctgggattgaaagtctctacattctttgcctgctcttccagttcttttgtggatttctgctctccctgtttcattttcatcacctctgggatagtatgtaccatgacagtgggaaacatgtatcagatatgcagtatcaaaaatctccgccccggcaaagcccctgtgtttaaaaaatcagccccggcacgccactggcaccggagctgatttaaaaaggggaggataagtattaattattttctctttcgtgtatactcctattatggccccatcccaaagaattatacacacccgatacatttttttaatttattttcctctcccctgtttttcccgccattcccgctcccctgccgtctgttttattccgctctggctctacagtatcatcatcagtgtcccggtaatcagcaccgtgctgatgacgacggatatagagtttaccgcgcttgccagtcccacatccgcccccaggtttcctgtaaatgcaggtgcggcagaggacatggggctgagggcaagtatggtcagagcctgcctgtattctatcccaaagggcagcaggaaataaaagaccagtgccagtacaatggccagtgaataccgggccgcaagtatcttcacgattttacccggctggctgctgtccccgttcagcttaaatcccaccccaatcataagcatggccataaatgcatttgcatttccaatcactccggtaaatgaggtaatgggggccggcagtcccacatggagaagcgacagcacggtcataatcagatatgcgtcaaaaggaatggatttgagcagcgtctttataaccggaaacatgctgaacctggcgttcttctcctttgtcgccaccgccgcgctgtaggccccgcccagacagataaacgcgtttccggtatcaaacagactggttgccaccacaccaacaggacccaggaagctctgggcaaagggcatagtaaaattacctatattgtatcctggcaaattcagtatattaaatgcccgttcttcccgatcttttccgatactcataaaaaaggccacggcgatatacaaaatgccgcctgcaacccccagcagtgtcaccaccagcatggacggcttcaggtcgatccctgaaaaattagatataatcgccgcgggaagggttattttaagtacaattttcgataagacataaaaatcttcctccttaaaaaaacctgctcttctcagcagatttcccattattatgacagccacaaaagaaccggcctttatcaacacttctgccattttatcatttctcccatccgttttctcttcccgccccggcttttgatttaaaccttttattttaaaccttcatttcgcaaatcctggttatcgcaagtccctgttataatatcaaaaacaacggcagactgcaataacaaaacaatatgaggcaggcaaattgaggcagacaaatccccaggaatccccgaacagctccagtacatctccggtacacccccagtataatccaagtacatctccagtacagccggaggacagaaagaaagaccggacgcccaacctggcgccggtctctccaatccctttatgaaacagcacacatgctcacatgtgtcccggtcctctgtctcctttaaagggcagctttgtactccggattcccgtaccgcctatacatatcccagcagtcccggcagccacatggacagaatcggaacataggatacaagcagcagtacaacaaatatggccgcaaaatacagcagcaggggtttaattacattttcaatcttggtcttacccacctttacacctacaaacagcgtcgttcctaccggaggcgtgatggttccgatacacaggttgaatatcatcataataccgaaatgtacagtattcatacccagggcctggcagattggcaggaagataggtgtgaagataagacaggccggcgtcatgtccataaatgtaccgataatcagcaggaggatattgatgataaaaagaatcacataccggttgttgctgatacccaacattgcctctgatacggctgtggggattccggtaaaggccataacccagctcatgatgctggacacgccaatcaggaaaataatgatgcctgtcatctccgcgctgtccaggaaaatcttaggcagctcagagaattttatggacttatagaagaacagggaaagaatcaggctgtacaccaccgccaccacgcttccctcagttgcggtaaaaataccgctgataatgccgccgataacaatgacaatcatcagcagacagggaatggcctggaagaacacctttaccttttcactgttggaatatttctttgtgctgcggtaccctttcttcttggcaaaatagaagataaccgccatacaggcaaggccccagaggatgcccggaatgtatcccgccatgaacagggctgccaccgaggtgccgccgctgaccagggagtaggtaatcattacattgctgggaggaatcagaagaccggttggcgccgtggcaatattagcagcagcagagaaatccctgtcatatccctcctcttcctcaataggcccgatgatggaacccatggcggaggcagctgcggtaccggaaccggatatggcgccgaacagcatgtttgccactgcgttggtatgggccagggcgccgggaatgcttcctgtaaaaagctttgcaaagttgatgagacggatggcaataccgcccttattcatgatatttcctgccaggatgaaaaacggaatggcaagaaggctgaatacggatatgcctgaaaaaattctctgtgcccctgtaagcacggctgctcccgtattgagtaccggaagaatggcacagatggatgacactgccagggctaccgcaatgggaacccccgccaagagcatcactactaaaagcaccaaaataatcagtccgcagactactgctatattcatactcctgcatcctcctttttaccaaaacccgtgtgcagcatgtctgccgcgttcatcagactgaacatcatgataataatgcctgtcacaggtacaatcacatagatatatcccataggcactctgagggatgctgtggtctggatcatggtcagctttgtgatggatataccgccgtaaaccatgaccacaccggcaaaggcaaaggtcagcaggtcaatgatgacttccagatatttcttggctgaaccgctaatcttatccgccagaaaacccatcctcatatggtcccttttgccgaacacataggcggaagccagcagggccatccatgtgaagctgtaggttaaaagctcctctgaaacagtactgggcttattgaagaaatagcgggtaacaatctggtaggtcccgattatagtcatcaacataaacaggcagataataaaaactcccagaatctgcatgattctggctctcactttatgcattgtctccatcctgctttcctcccttcgctttttcgtttatttcctggatatgattgtacaggtccacaatcttgggattatcctttaacatggtctcatgaagaggcagcaccttttgtttgaacgcatccacgtccacatctataaattccacgcccattttattctgtgcaatgtccttggcttcctcaatgctcttatcccactcctcaagctccacctctgtggacagggctgcagcgtccttgaatacctggtattcctcagggctcaaaccgtttaaaaatttcagattggcaaccagcatatccggcaccatctgatgcttgttataggcataatacttggcaacctcgccgtgcttgttgttggtaagggccagctcgttgttctccgcaccgtcgataacgccctgctggatagccgtatacacctcaccgaatcccatgggggctgccgctgctccgaaggcattgaccatggccacgctggccgggctctgctgaacccttatcttctttccctttaagtcatcaggggtatgaatcggagtcttggcataaaaattcctgacgcctgcattgtaccaggtaaccaccctgaaaccggcttcgtccgtggactcataaaccttttccatgtagtccgtatcctgcattacagacttgtacacatcctctgagtcgaaaagatagggcatactgaatatttcgtatacgcctgcaaacgtctcaagattggcggttccggccacaacaaagtcaatggcccctgtctgggtcagctcaatggccttctgggcagaacccaggatttcattggggaatatctggacctcgtacttgtcccccagccgttcctccacatattccttaaaagctaaaagccctatatgctccggatgcgtctctgactgggcatgggatacacggataatccgttttccggaagtcactgagccacagcctgtaagacctgctgccacagcagccgcaagggcggcagccgccactctctttatgaattttctcacttttttcattcctttccctttatacggcaaattcttttgtttcaatacatcccagaaacctgcgttcctgtttattctggactgaaatactgtttcccataccgcaaaacggcggccttttgctgcccgttgcccggctcttccagagtccgggcccttttctccacaacaaaagccccttggctatcaaccagaaaacgttaagattttttggcgccttcttaacactttcttaattatatagccaggggcttttattttgtaccgtaaaagtttgtcatacaggaagaagattttgtcctcccccatttttttctagttaccttcgcataaatgcacaaaaaccctgttctatttttgtgcagtctcactatccctgtactcggatggtatcattccggtcatgcgcttgaacacttttgcaaaataattggaatcataataccctacctgcatactcacatccttgacacttatgctcctgtccttcagcagttttttggcctcgtttaccctgaaaccggtgaggtaggaggtgaaattctggtcaaagcactgtttgaacagcttgcagaaataggcgtctgaataattcatcatcctggcagcatcctgcatggatatttccttcatataattattccgtatatactcccgaatggtttccgccacctgggccaggcgtccgtccccgtcatccctgggcatggcttctgcatgttcctcccggcggatatccggagaaggaacacctggagaaggaacgcccggagaaggaacacccggagaaggaacacccgaaacactcagccgtttatccgtcagccgcatggcctcctccatgacggccaccagctcatcctcctcgcagggcttcagcagataatccagagcccgtatgacaatggccctcttggcataggaaaactcatcataggctgtcaggaaaataataatacagtcctcgtccaggctgcggatgcgttccgccgcctccactccgttcatctccggcatggatatgtccatgaccacgatctggcttttttcccttttgaatgtctccagggcctctgccccgttcactgcctcgctgatatccaggctgccgcaaaaatgcctcttcagacgcttggccagcgccatacgttcaatctgttcatcatccgccagcaatacacgatacatatacctcatcctttcgtcctgtcatcagggtgtaaaggccatctgcacgaccgttccccgtccctcactgctgtatatgaaaacctcgccgtcccggtacattccatggaccctgcggtaaatatttcccacgcccacgccggtggccttctcctctccccttgccagggcaaggcgtatttcctccagccgttcctgcgccattccccgtcctgtatcagccaccgatatccagagccgccttccctccatccaggaacggacatgtatccttcccccctgtcccttgggagaaatgccgtggataatggcattttccaccaggggctgcagggcgaaggaaggcaccagcacctccatggtatccggcttacagtcagtgtcatagcggattctctgtccgaaccgcatctgctgcaaatacatgtagtcctgcaccaccttaagctcccgctccaggggcatcacggagtccgtggatttcaggttatagcggaacagcctgctcagggcatggatcatcttctctgtggtgtctgcatcctcaatctgggccgtactggcaatcatattcagtgtattgaacagaaagtggggatttatctggtttttcaacatctgcagccgcacctcgtccagctgcttctccatcctgtgcttttccgtcagggcttcaatatatcccctggtactggctttcatggtgcaaaaggccctgaccaggctggcaatttcatcactgccctccgcacaggtgtccgggcccgtgaaatcattttcccctatccgtctggagtcctccgccagctctaccatggggcggacaatgtttttctgtacggaacggttcagccatctgaccatcaaaagggctgccgctccccacaaaatactgactgccggcacaataatgaacagcgggcgctgcatctcataccgctcattgcccgactgcacggtcatctgttccagacggcccgcatgggttgccagatatccctgaacccggtaaatggtatagaggcggtccagataatccggcgccccttcctccatctccagaaacgcatccctggcagcggcgtaattctcatacatatttaaaatggaccaggtgaccccataacggtccccaccgatctcctcatagtcaaagggcagggacttaagcgcagagcgggtcctggcgcaggacatctcatatttctccctgttttcaggcgacctgtcccctgcgtaatactggaaggaactgctctcagcatccatggccgaccagaaggccaggctccgcgaattgcccataagcaaatccccgaatcccttcatgccatagccggcgatcagcatgaccgctgttatggacagtataaccacggcggccgtggaaatggtaatccatctgaccttccgctccagggaacatgacatccaaataccatgcagttttcttcccagccttccttccatacagcctacctccattgttcatagcttattctataatagaatttaccattttggaagagacaaaccaaaaacatggcggaactttgtatttttccacagcaaaaaacgcctgcagccagtaagacaatctgcctttaactgacacaggcgttctcctgcggccgccggccataagctgcggaccatcacagcagctggtccttttcggaaggcacatacactgcaatatcctcaatatcgcagtccagtatcctgcaaaggtcgttcacagtcttcatggatatgtccatgttgtgtttcagcctgtgaagggtactgtccgacacgcggtgcttctttgtaagtgtgtaccaattttcctcagattgctccagtgtcttccagaatggtgaataatctatcatctttatctcctgtatacgctcaagccgccgaagggctggtttcttagatagattaagcataagttagatttcacatcttgaatatcttcgcaattacgaatatactatataaatgtaaatgctgttgtttacatatctgaaaggcaggacaaaacaaatggattatttcacaaaagaaggcattgaaaaacttctggaggatgaagaggtagtccgccgtttgacggagttcatggccatggatggagaaacctttttcaacgaggtgcgttcccatctgtcccctgaggagctggaagaatatctggaggaaaatccggacgagagaatctatctgaaaaagtaggaatccatcagatatatccatcaagcaaaagagcggcctgtcaaatgacaaaccgcccttcttcattttcttcctcaaaataatctttatagtccacctcaatggaatggcgcatacgcttcatgctgtaatagaggtgttccttcaaggcttcctccagccctttttcatttttatccgcaatcaggcggaatagatcctcatgctcaccgataatgcgcataaaatcagtttccgtgataaagtccagcatcctgaacctggtatagtggagctgctgggcctgaagcatctcccacagcttctgacgcctgacagccgcaaaccagatggagtgcatctgcgcgtccatgcggtaaaactgctccggctcaaagcccggttccctgataacagccctctgctgcgcaatgctgtggcggatgtcctccatgaccatgggcgtctggacttccaggaaatccctgagcaccatggtttccacagccacacgcatatatatcatctgcttgatgttatccaggctcagaagggtcacataggtgccgcggtagggaatggtctctgcaaatccctgctcctgcaacagccggagcgcgtcacgtaccggtgttctggacacaccaaagcgctcgcatatatcattttcactaatcatctggcccggcttaagccttaaatccaggatttcctgcttaagtgtctcatatacaagctctccccggttcttgaagttcatctctcccatggctggccccccttatcaatacccgcatacagcacaggcataaaatgccgctcttcttatcaaacagtccggccgcatcaaaagctgccggactgccaactggtctatattataaatgattcccccggaaaattcaagccggattatttaggctgcttgccgatgtatgccaggattcctccgtccacatacagcaccaggccattgacgaaattggatgcgtcggaagccaggaatacggcaggtccgcccagatcctcggcctcgccccagcgccctgccggagtcttgctcacgataaactggtcaaatggatgtctggagccgtcaggctgaatctcacgcagcggagcggtctggggagtggcaatgtaaccgggcccgatgccgttgcactggatgttgtactcgccgtactcggaagcaatgttcttggtcagcatcttaaggccgcccttggctgcggcgtatgcggatacggtctcacggccaagctcgctcatcatggagcagatgttgataatttttccgtggcccttcttaatcatgctggggataactgccttggacacgatgaacggcgcgttcaggtccacgtcgataacctgtctgaactcggcagccgtcatatcgcacatgggaatcctcttgatgatgccggcattgttcaccagaatgtccaccacgcctacttccttctcaatctttccaaccatctcattgacggcgtcctcactggtcacgtcacatacatagccgtgggcttcgattccctcttccttgtaagcagccagtcccttgtcaaccagctcctgcttgatatcattgaacacgatggttgcgcctgcgcctgccatggccttggcgatggcaaagccgattccgtaggatgcacctgtaatcagggctaccttgccctccagtgaaaagttatttaaataatctgccatttctttttcctccttgatttgcttatttcatctgattgggcatcatggtgtccatgtcgtcaaactccatgttctctccgcccatggcccagataaatgtatagttggatgtgccggctccgctgtgtatgctccaggaagggctgataacagcttcctcgttcttcatcacaatgtgccttgtctcggtgggctctcccatcatgtggaataccacgttgtcgccgggaacctcaaagtacatataaacctccatgcggcgctcatgggtgtgggacggcatggtgttccatacgcttccctcctccagcacggtcatgcccatggacagctggcaggtcttaagtacatccgggtggataaactggttgataacgcgcttattggctgtctcagatgctccgcagggcctcttggctgcctttgcaatggggatgtaggtggtggtgtaggaagtatgggccggtgcgcttaccatgtagaacttagccggtgcagacgcatcgtcgctggaaaaatatacttcctttgttccttttgtgatgtacaggcagtccttatatcccatctggaattcctgtccgtcagccacaatcctgccgcttccgccgatattgaaaataccaatctcgcggcgctccagaaaatagtgggttccgaaattcttccagcagtcaattcccttatctatggaaacagtttctgtggtaggcatacatcccaatgtcaccatacgatccacatgtgaatacacagccactacctcattggccgcatacaggttctgaatcaggaactcatccctcagctcctgtgtggtgtaacgctttacatctctctgatttgcagaatagcgaatatccattatcttgtttcctcctttaaacttgatttcctttaaatttagtttcctttaatcttagattcctttaaacctgactttcttttgtgtttacatttgcctttgcgatttagattgcgtttgagtttgagtttgtatttcttctcgataacttgtatacaactttttaaatctgtatacagattaacacagtcgtatatctttttcaatgggcatattctacaaaattgcagtgattttctatgcatgttcacaacagtaaggcttgcgttgtgtgtctgtttattatatacttgaccgtgtttgaccatgaaacattacagcgaggagaatgattatgaaaaaaaacatcctggtgggccagtccggcggccccacagccgtcattaacgccagcttatatggagtcattgcagagggcatggcccggccggaagatgtggaccatgtgtacggcatggtaaacggcatcgaaggcttcctctcaggccacgtcatggacctgtcctctcttacccatgaggacctcatcctgcttaagcagactccggccgcttatctgggctcatgccggttcaaactgcctgaaaacctggatgcgccggtttacagccttttatttgaaaaattcaaatccatgaacataggagcctgtttctatatcggcggaaatgattccatggacacggttgacaagctctcacgatgcgcccggatccgccgtgaatccatctccttcatcggagtgccaaaaaccatagacaacgatctgcctgtgactgaccatacccccggatatggaagcgctgccaagtatgtggcctccacggtccgtgaaatttccctggacgcctctgtgtaccagcagccggctgtcactatcgtggaactgatgggacgccatgcaggctgggtaacggctgctgccgccctggccagaaaattccccggcgacaatcctcttctcatttatatgccggaagtgccgttctccatggaacagttttttaaggacgtggagcaagccctgtcccgccagcccaatgtggtaatctgcgtatccgaaggcatccgcgacaaaaacggccgttttatctgcgaatacaccaatgaggcccagattgacaccttcggccacaagatgcttaccggctgcgccaagatactggaaagctatgtccgcaaccgtttccaggtaaaggtccgctccgtggagctgaatgtaaaccagcgctgcagcagccttctggcctctgccgccgatgtgcaggaggcagagagctccggcagaacagccgtagaaaaggccctgcagggagaaaccggtaaaatggttacctgttcccgcctgtcagggcccggatatgaacttgaatatggacttacagaggtaggcaatgtgtgcaaccgcgaaaaatcctttcccgtggaatggatcacggcggaaggctccgatatcggaccggaattcctggactatgcccttcctctgattcaggggcagccggaccacatcatggaaaacggactgccaaaatatctctgcaggaagtaagcgtctcagccgtcacaccccggaatatgccgaaaacccgccgtccaccggaagtatgattccggtgataaaaccggccgcctcattgttgagcaggaacatgagagccccgttcagctcctcaggcctgccgaaccgccccatgggggtggcggccagcaccttggcggttctggccgcgggctttccgtcctcctcatagagaaggccctcattctgccgggtcacaaagaagcccggagcaatggcattgacccggattccggcttttgcaaaatgcacggccagccattgggtgaaattgctgagcgcggccacggccccgctgtatacaggtattctggtaaggggcctggccgcgctggcagaggagatgttgatgatattgcatccctcccgtcccaccatatccttggcaaagacctggcaggtcagaaatcctcctaaaaaattcaaatccagcacaccctgcactcccttatactccatatcaaagaaggtagccacatcggcctctatatcccccatctcaaaatattctttcgatgtattagccccggcctggttgcctcccgctccgtttatcaggatatcgcagggtcctaaccgggccagcaccctggcatgaacgctctccagcatctccttatccatcacatccactccataggcagcagccgtccccccagcctcccgtatgtccctggctgtctcctcagccgcttccaggttaatgtccagaagggccactgctgcgccggctctggccagcgtcctggcaaacatgccgcagaggattccccccgcgccggtcaccaccgccatctttcccgtcaaatccgtccccaataccacctttccttcctcctttcctgctctttactttcattcttttcccattcatcctcaccggctgatggacaaaaagggcctgagaacgttcttcccggccctttcctgatttatattgtgttttttgtctgattttgtgctgtacagaccggctgtcaggacattacctgctcattttctccacagcctcgaacaggccattgaggtaggtagcgcctaatgctctgtcatacaggccgtatccggctcttcctgtctctccccaaatcatacgtccgtggtcaggtcttacatagccgtcaaaaccattctccaccagggccttcacgataccgaacatgtccagggaaccgcagcaggacagatgtgctctttcctcaaagccgttatccagcacagccacatttctcagatgcgcgaagtggattcttcccatggcggcgtatttgccggccagtcttaccacgtcgttcttagcagagcagcccagggaaccggtacacagtgtgattccattgtgcctgtcatccaccagctttaagaacttatccagattctcctcacaggtaatgattctgggaagaccgaagatgctccagcatgggtcgtcctcatggattgccatgttcacgtcgcactcggccgcaaccggaataatgcgctccagaaaatattttaagttatcccacagattttcctctgtcaggctgtggtattcctccactacagccttaagtccgtccttggtgtagctggaatcccatcccggaagtgtcaggtcgctgtcgctgttaagagggttcactgcatctacctgctcctgatagtacaccagggaggtggaaccgtcagccagctcatggtctaactgggtcctggtccagtcaaatacaggcatgaaattgtagcagatacatttaacacctgcctccgcaacacggcggatgttctcacagtagttctcgatgtacttgtccctggaagccttgcccagctttatatcctcatggacaggaatactctcaatcacatcaaagcccaggccagcatcctctacctgcttcttcagctttgcaatgctctccctgctccacacttcgcctaccggaacatcgtatacagccgtaacgatggactgcatgcccggaatctggcggatattctccagtgttaccttgtcgtcttccccataccatctgaatgataatttcatgtgtaaactcctcctgataagtgttgttttacgttccctaacctatggttttattataacagaaaccatttttccgtccatagtgatacttgccgtccatattgcaaatgttgttgtttcatgctaagatggggataaaatcatgataaatcatgtttcccgagaggagggactcccgtgaaaaaacagctgtccatggactttaacacacggcaatacatgcagtccggagactttgaactcttctattacaatgacactgcgcttaaatccgtagatgcccatgaacatgactactacgagttctattttttcctggaaggcgatgttacataccacatcggtgataaaagctatcagcttgaatacggggactgtctgctgattccgcctgataccccccattatccccagttccattcctatgataaaccctaccgcaggtttgtattctggctgaatcaggattaccacaaaaagctgcgccagaccaacgaagatttgacatattgttttgactatgcccagagccaccaggcctaccggttccacacagacaccattaccacccaggagattcagggaaagcttaccgacctgatggaggagcttgcgggcggacgctccttccaccgccttgtctcggagctcatggctgtctccttcctggtgtacattaaccgccttctctatgacagcctccaccagaaatcagctgtctatgaaaatgttctgtacctgaacatctgcgactatatcaaccggcacctggaggaggacttaagcctggacagcctgtcgtcctttttctatgtgagcaaataccatatctcccacatcttcaaggacaacatgggtatcccgctccaccagtacatcctgaaaaaacggcttcacgccagcaagaacgccatattgtccgaccagcccatcagccatgtttacctccagtacggcttcaaggactacaccagctttttcagggcattcaaaaaagagtacggtgtttcccccaaggagtaccgggagcagcaccgcctgcctgaacagcaggattacaccatataaggggatttgactgacatgaatacacctgacatcctttcctttgacacatacagaaactgtatcctctgccccagaatgtgcaaagccgaccgcagccgcgccgcaggctactgcggctgcagcagcgtccttacggctgccagggccgcccttcaccactgggaggagccctgcatcagcggatctgcggatgcagacggcggtttaacagcgcccggcggcgcccattcggattccggcggcagcggcaccgtctttttttccggctgtaccctgggctgctgcttctgccagaatcataaaatcagcagcgggcacttcggccgggagatgaccgctgaggaactgggccaggttttcctccgtctccaggaccagggggcatataacataaacctggtgacacccacccagtacctgccccatattatctccgccctggaccaggtacgctttaagctcaccatacctgtggtctataactgcggcggctatgagcgtgcggagacagtaaaggcattaaaggattacgtggacatatggcttcccgacttcaagtactatgataaccgtctggcccagagatattccagggctgcggactattttgagacggccgctgccgccatccggcagatgattgaccagaccggcgctcctgtttaccagtctgtctctcccggactgctggcaaaaggtgtcatcatccgccacatggtcctgccgggacagcgccgtgattccattgccctgttggaatggataagcggcaatctgccccggggccggtatatgatcagccttatgagccagtacactccctacatccaaaaccaggaattcccggaactaaaccgccgcatcacatcatacgaatatgacaaggtggtggatgccgccatccgtctgggactcacccagggcttcatgcaggaaaaaagcagtgccagggaagaatatactccgccctttgatttggaaggactctaaggtattcgggacatatgaacgggtttcagaacaaaaaaagcgcctgcctcatccggctgcgccaccccgtttttcttttcccctgtcccccaaacctgctctctaaagtctttccttaatctcatgaaaacatgaagacggatatcgaatctttgactaaccacgttcgcagattacgatatccgtcttctaactatttcgtccattggactaaacctcacttttccgaaacaattcttttaattatttctggcttttctatattaagttgttacaccattctacgttctgttacttcgctcctacttctgcatttcttcacttatgtctgattcatttcttttattgctttttctttactatccggtatcatctttcgttctaataatactttctcgtcatatcaccaaaccgaatttattttttctgatactcttgagatagtgttacaaattcaatcattcatttgttcataaatgcttcactcaacagtctgtatctttaattcatatctttaaaaaactgcaattgctcttaaaacattcaatctatataacttgtatttcgattattaaattatctgtctgtgaacttacccattcacatattagtttctttaactcatgaaaacctgctacttcttgaattgtttaccaaccgattggattcctgtttctttaaatcaatttcttaaaattacttatctgtttgagcgtttcactttggtagattggtttttcctggtctcatttataattaaatttctttaagttataaatgaaacaaaatttaagtctttggcggtccgtacctcctttgcttggattttattacttgtgaactgattgtctacagttccttgaaatcttttgttctctgttcttttgttgttttcattatagtaaatgcccccgcatttgtcaacacttttttagtttttttattatttttttagtttattaatatttgaatccattttattacaattgtttccctttttatacatatcttaatcttatatttgtgttaattgtttaaatattctgattttttctaaaaaaagatacctattcctaccggatacaggtatctttttcctgttatttactttttatttgtttgaatcatccctcaaatgcttccacttcttccctggagggtatggagggtgctgccccggggcgtgaaaccgcaattgcggctgccttggcagccaggtcaagggcctctcccgcatccagcccctgcaccagcccgccaataaggaaaccggtaaatgtatcaccggcagccgttgtatccgccacaggaaccttgtagattccctgtgtcaggattcgttggccgtccctgtaaagggagccgtcccctcccagtgtcagaactatctttgacgccggaaatttgtcagaaagcttttggagcagctcctcaccgcttccctgctccccgcatatatctcctgcctcaatctcattcaacaggaaataatccacatattccaggggataggaactgattttatcgtccatgggagaagggttgaatacgagaaccatgcctttttcgcgggctctctccatgatatagccaatctcgctgatttcattctgcagtaccaggtagtcccccttctcaaagtggtccataaccccatccaccatttccctggtaatctgctggttggcgccgccgaagagaagaatgcagttgcccccgtcctttgccttctggataatggcatggccggtctttccatccagcacggatatgtactccgtattcaccccggcttcctttaactggcggatgagaaaatccccgtccccggtgccgatggctcctgcgtgccatacctctgctccgcttttactcagggcaatggactggtttaatcccttgccccccgaaaacacatgcatttcctccgaggacatggtctccccgcccctgacaaaatggtccacactataggtataatctatgttcagtgaaccgtaattaagtatcttcatgattctccttctcctttccattcgtttcattctttattcttccggcaccatcttccccacatcctggggaatccgggtcaggtcccgctccacaatcagatatatcactgcatccggagggttctcctccagaagcgaccggtcaaaggcctgccagtgataaaagtccacattggcaaagtacctgggcaggaaatccatgagggctgtgccgaaggaatcccgtataacagcaatccggcgcttatccggcgccccgggtgtacttgtatggacaatattcttatccccgtttacatcctgcaccgtgacctcaaggtcttcatgatacccgcttacaagggcaatctggtcatcgcagtatttctcaggcaggtggaacagattggccaggtcacccggggctcccttgatataatccacctgcacatcctctatgggcagcggtgtccctcccaatgcctcaatgagcatctggcctgccgcgtatcctcctgcgctgttccagtgggtatccgtcttataataccacacataatcccggttcgtgttaaagtactccctggggtccagaaccgtcacatccgagtgctcccgtatgtaatcctccagctgtccgggccggtttccatcccagacccgcttatatgcatccggcatatattccctgtagattccttccttgttgggagcaatcatcatgagaaagggtatgccccggctctcataatatccggctgcctttatgatctgtccgccaatccaggcagcatcgtccgggtaaaagggctgtgttcccagggcgtcataaaggctcatgcccccggcaaaaaagtaccagccatcctttcccacaatcacatcctgggaatccgcatagccgaacagctttaaattaatcatggaattcaggctcaggaacagattcctgaatgccgcatggtcattgatatagctgttgaccgcagacggatacgcctcatatgtatccggtgaaaacacgggaaactctgccaggttcctgttttccccggtgcctgtctggctgcctcccttcacaaaggggaacagcaggttgggtatcagaagcagggcccagaaccccgcaatcataatcttcttcatcataggtgctgctctctttccgtatggactaaaatctgaaataaataaaggcctgataggtgctgctgaccatgagcagcgttcccagcagcaaaagggctgccatcacagccgcatccgctgcggtcacgttctcctcatcaaacagccgggctttgagacggggcatcagctgctggatgggcccgcagaataccactgccagcaccagcagaaacagaatgcggttatccgcgaaaatccgcggattccacagtcccttgctgggaatcagcattgcctttaacagtatttttccgttgtgcagggtatccacccgaaacagcagccagcccactgccaccgccccaagggtgtacagatgattcaggaacttcaggggatttttttctaaaatcctgccaatccacaggcgttccgccactataagaatgccgtaatacacgccccagcatatgaagttcatgctggccccatgccacagtcccgttgccaggaataccaggaaaagattcacgcaggtgcgcgccagccccttcctgttgcctcccagaggaatgtaaagatactgcctgaaccaggtggagagggagatatgccagcgcctccagaactcgctgacagaggccgacagatacggataattgaagttctctttgtaggtaaagccgaacatcctgcccaggccgatggccatgtcggagtacccggaaaaatcatagtaaatctggaagctgtacagaatcacggccagccataccgtaaccgtgcccagctgttccaggggcaggtcaaacatacggtccaccacctggccgaacatgttggcaaataccattttcttcaccaggccgtacacaaaacgcttaataccgtatgcgtgcatagccaggctctcctgccggttcccaatctgcggttccagctcatgatacttgacaatgggaccggaaagtatctggggaaacaaagagatgtacagcgccagacggaatacatttctctgggcgggattctccccgcggaaggtatcagccaggtaagagatggactggaaggtgtaaaatgatatgccgatgggcagcgcgatatcccttggcgcaaagccctggcgccccagaagggacatggccagttccaggaagaagttgaaatatttaaaataccccaaaagccccaggttgaccaggatgctcaggacaaataccgccttcttaagccctttcctttccccgcagccatccagagccaggccaaacccgtagtttaacaggatggaaaggaccaccagaaccacataccgcggctcgccccagctgtaaaacacaaggctggccatgagcagaaccccatttttaagcttcctgcccggtgaaatatagtatatcagggccagggcaggaaggaaaaaccatacaaacgtcagtgaactaaacagcatatttaggaaaattccctttctatcaaagtttatcaatcatatatcacagagatacaggctacatggagacagcatcctgtcttggaatcttgcgccgtatcttatggaatgtcaccatatgggcaatggcagtgatggcccaggagacaggataggacagatacagcacgtccagggaacggtacgccgcaaatacggtaaatacccagagcaccctgaatccgcatgcccctgtgagggatacaaacatggggataatggaatatcccagccctctcaggcttcccaccatgcagtccatgattccgcacaggaaataggttgtgcagataatctccagcctgagcatcccgtagcgcagcacctccgggtctgaggaatagatatgcaaaagcccgtctcccgcggccacggctgtcagtcccaggattaaacccacggccgttaccactcccaggcatatgtacatgattttattaatcctgctgtacttcctgccgcccagattctggctggtaaagctcaggttggtctggtacaccgcgttcattgccgtatagacaaacccctcgatgttggaggaggccgtgttcccggccatggcaatggaaccaaaggagttgaccgaggactgaatcagtacattggatatggagaatatggctccctgcatgcctgcaggaagtccgattttgacgattcgtttcagctttctggggtgaatccgaagctgctttaaatccagcttaagtgctcccggagcgctcatcaggctcttcagaaccagaaaagcggagatgtgttctgatatgaccgtggcccaggccacaccgtccactcccattcccagcaccaccacaaaaaacagattcaggcacacattcaccacgccggaagcaaagaggaaatacagaggtctcctggtatccccgatggcccgcagaatggctgcgccgaagttatagaccataagtaccggcatacccagaaagtatatcctcatatagaggaccgactggctcaggacgtcctcaggggttcccataaggcgcagcagcgggtttgccagaagaattcccagcaccaccaggataaagccgctcacaatgctggtggtcaccgccgtgtggacggtctcgctgacatccttgtctttccgggccccgtaataccgggccaccagcacattgacaccaactgagagtcccacgaatacattaattaataggttgataagcgaagatgtggatcccactgccgccagagccccgctgcctgcaaaacggcccaccacgatgatgtccgctgcattaaacagcagctgcaatatacccgacagcatcaaaggaatggaaaataaaaggattttgcccagaagcgggccgcttgtcatgtcaatctcataagactttttcatcttctgttaactccctgtgtcattctttctccatgccagtccatggcatatgttcttatcagttatatcacagggccgcgttttttacaatgggttaaaaggccatgaaaacctgcgaattttcttgacatttccaggcccgtcctttaaaatggagcaagtgataagggagtaattggcatgccccgccctgccgggcatgtaataaggtcaacatactgatagtttctatctggctttatttgaaacaatgagacttatctacagcattccaaggctgtaggtgggtctttttttataccacaatccatatattaaaacatcaccagggaggaatcattatgtcattagctgaactgttcgtcatcgccgtggggctgtccatggacgcgtttgcggtatctgtctgtaagggtctggccatgcccaaaatgaactggaagggcgcccttttggtggggctgtacttcggcggattccaggccgccatgcctctgttcggatatttcctgggttccagcttcagcctggccatacgtgcttacgaccactgggtggccttcatcctgctggctgttatcggagcaaacatgataaaagaatccttcagcaaagaagatgaatgtccgaacccggatctggatgttaaaaacatggtgcttctggccattgccaccagcattgatgcactggctgtaggcgtgacctttgcctttctgaatgttgacatcctccccgccgtatcctttatcggaagcgtcaccttctttctgtccgtggccggcgtaaaggcgggcaacgcatttggatgccgctataaatccaaggccgagctggcaggcggcgccatcctcattctcatgggattcaagatactgctggagcacctggggattttgttcgggtaagctgtacataagaatcccgcggaacgtgccgttctccctgttccatactgccatatccccgtaaagacagcggggcagcgtcctctcggaatacgctgccccaccgtcttttatattgtccttttcctgtctcaaatcctgttcccaggctcagaaaccattgccttcccggcctcagattctgacgccgctgctgtccagctggtaaccgtcaatggtgcggttcgtctgcatcactccgttttcagggtccatataataccactgtcccttatattccagccagccggtctgcatatagccgtctgtgttgaaaaaataccacttgtcgtttatcagggcccaggatgtaaggtattcatcctgatacagatacctccagccgcgcatatccttgttccacttgcccagcaggatattccggtagttgcccatgtcctcctcaggaagcagcatgaaataccggctctcctttttatcctgataacagaactctaccatataacattgatccagataattgtaatccccctcaacggaccgttctttttcaacggtctcaggccggattacagggtaatgggtcccttcctttaaaccgtacaccgtacactccagatacttctgggtctcgcctctataggtgacaagataataattcagtgtcacttcattcaggtccacatcacttttgtcctttgtaactgtgaacgtatcgtattccgataccctgtaccccagcagataggacgaatatccgtcgtaaatcgtggtccttctgctgttaacatccaaatgcagggtaacaggcacctcagccttatacgaggccgctgcctctgagacaaatgcagccgacacactgagcactgccgccagaaccagcgcgcctaaccgcttaacagacatataccgtctcatccggtaccctcctctcaaacctttggactactcatgatgacatccagggtgaattcccggcgcatccgccagccattatttcaatataatcttcttgaaattcttcttgccgcgcttgacgaccacgccatctccggcaaactgttccctggagaatacggccttgatatcctttacaggatttccgtccacggacacaccgccctgttccacgttccttctggcctcagaacgggacgctgccaggccggacttgttaagaatgcttaagatatcaatggttccatctgtaaagtcctcttctgaaagttcaaaagtaggcatgttctcggtactcgcccctgccgcaaacagggccctggcgccttcctgcgccttggctgcttcttcctcgccgtgcaccagctttgtaagctcgaatgccagtatctcctttgcctggtttaactggcttccttcccactgatccatctcgtcaatctgctccagcggaaggaaggtaagcatgcgcagacacttaagcacatcggaatcccccacattcctccagtactggtagaaatcaaagggtgatgtcttctcaggatccagccatactgcgccggactgtgtcttacccatcttcttgccctcagagttaaggagcagggtaatggtcatggcatgtgcatccttgcccagcttgcggcgaatcagttctgttccgcccagcatgttgctccactggtcatcgccgccaaactgcatgttgcagccgtaccgtttgaacagctcatagaagtcatagctctgcataatcatgtaattgaattccaggaagcttaagcccttttccatcctctgcttgtagcattcagcccgcagcatgttgttgacggaaaaatgtggtcccacttccctgaggaactcaatatagttaaggcccatgagccactccgcattgttcaccatcatggcctttccctctgagaaatcaatgaaacggctcatctgctttttaaagcagtcacagttatgctggatgatttcaggggtcatcatggtgcgcatatcagagcgtcccgacgggtcgccaatcatgcccgtgcctccgccaatcagggcaatcggcttgttgcctgccatctgaagacgcttcatcaggcaaagcgccataaagtggcctacgtggaggctgtcagctgtcgggtcgaaaccgatatagaatacggcctttccctcgttgaccattttcttaatttcttcttcgttggttacctgggcaataaggcctctggcaaccagttcttcgtaaatctgcatggtgattctctcctcttcttactttctttattttaccatacttctgctttcatgcaagggcttgattcttacattttttatacaggggcagcagggacacagggcgtaccgcggacacggatttccctttctgaacgaaaaaaagccccgccctttctcaaaaggacgaagcccgtaagccccgtgttaccacctgatgttcacagacagctcacgctgcctgcctcttcgagtactggcgccaggctctggccaaacgcccgtatactctagcacgataacggatgcaggacccgtcgcagcctactaaggctgttatatgaagcagcgctgttgggtgcgaagctcagggatgtattcatgacctgcattccatgcgcctctcatcatccggctgctttctgtctgttcctgcaggctactacttgttcccgtcatagccaattcatgaaattatgaccattatagacagactctcccggtttgtcaagagctaatcagccatatgcaaagggaatcagcagccgtatgcaaaggaaatcagcggtgtgcaaaggtaagcacgaacacagctcccagtatcagggcaaatcccagaaaatcaggcagcgtaaaccgggttcccagccagaacacggaaatgaccaccgcggataccggttccacgcttcccatgatgctgccctttaagggtccaatcatgctgacaccctgaaggtacaggccaaatgcaatggcagtgcccaccaccaccacgcctgccagcgctcccagtgtaccagcatcccagaccaccccgtaattccagggctgaaccacggctcccatggcaatcccgccaaaaaacatgccgaatcccagcacctggtatatgtcatatttcaggataagacctcctggtataatagtataaatcatggagctcacagctgccaaaagcccccagaacagggcctctcccgtaatgtgaaaggaatgtatgtccccgtgggttccgatgacaaaggtgccaaacaaagacagcccaatggctgccagctcaagccccttgggaagccgcagctcccgcatgcacaccacggccagaatcagaatgggcgacaggtactggagtacggttgccgttcccgcgttggatgcctggattgccatgaagtatgtaaactggcagaaggtaatgccgaaaatagcaaatgccagcaagtggatggtatccctttttttccggaacaccctcagattctccctgccgtgaagcttaaatcctgccagcaccagtataatgcctgcaaaaaacagcctgacagccaccagccacggcgcctcgattcccttctgttcaaacaaatactgcccgcagcagcccgaaaatccccagcaggttccgcctaccagggccattatggttcccgctgtctgtctcttatcattcttcatctcacacgttaatctcctgcaacagtcatgtatctatttatacttggaaaacaccttattgtcaatattttcgtgggattcactatttacgaatccggttttctatactataatgaagcattgaaatgtatcttacaccgcagtccggtgtttacataatgggaggacgaaaaaatgggattcacattcatcaataagctgcctacgccggcagaaatccgggagcaattcccgctggccccagagctggcagaaatcaaacacgcacgggatgaggaaataaaaagggtatttaccggtgaaagcggcaagtttgttgtcatcatcggcccctgctcagctgacaacgaggaatctgtatgtgattacgccggacgccttgtgaaaatccaggaaaaaacaaaggacaagttaatcattattccccgggtctacaccaacaagccccgaaccaccggcgagggatatatgggaatgatacatcagcccgatcctgaaaagcggcctgatatgtttgaaggaattctggccatccgccatatgcacatgagggtgctgcgggagacaggtttctccactgcagatgaaatgctttatcctgaaaacatgaactatctctcagacatgatgtcttatgtggcggtaggcgcccgttccgtggagaaccagtttcaccggctggtggccagcggctgcgatgtgcccgtaggcatgaagaaccctaccagcggcgacctgacagtcatgctgaattccgtggtggctgcccagcttccccacgactttatcttccgcggctttgaagtacagtgccccggaaatcctctgacccacaccatcctgcggggagctgtaaacaagaggggccagtgcaaccccaactaccactatgaagatttgaagcttttatttgacctttataacaagcgcgggttacagaatcccgcctgcatcgtggacaccaaccacgccaactccaacaagcagtaccatgaacaaattcgtatagccaaggaagtgctccacagccgccgccactccggcgatatcaaacatctggtaaagggccttatgattgagagctacattgaacccggcagccagaaaatcggggaacactgctacggcaagtccatcaccgatccctgcctgggatgggatgatacggagcggctgctgtacgagattgcggataacctggactagcaccatactataacccaaacgaaatatgagcccggaaaaggacctgccatgcatcatccgtttgcatggcaggcccttttccattctgtgaaacattcttttgtttatgagcaagcttctgtttttgcttctggtctttgcttctggtctttgctcccgtttttcatccctagctggccagcgccgtaatcccaaagtatgccagcacaatcacacccagaataattctgtaatatccaaagaacttaaaatcatgctttcggacatagctcataaggaactggatggaataaatagaaaccacaaaggcaatcagcattcccagtatggtatagaaaatctgcggtcccgtaaatacatttcctgccaggaaatacttcacgattttcagcagactggctccaaacataaccgggattcccaggaaaaatgaaaactctgccgcggcagccctggaacagcccaggaccatggcgcccagtatggtggaaccggaacgggaggttcccggaatcaaagccagaagctgtaccatgccaatgaggaatgctgtcttggctgagatctgtcccaccttgttaaacctgggattggtgcacacgctgctgttctcaagtacaataaaaagtacgccgtatacaatcagggccgctgccaccacataggcgttaaacagatgtgcctccatccagtcatccagcaaaagtcccagaatggctgccggaacacaggcaatgataattttaatccaaagggcccatgtggcatccttctgccggctggacttgctggggctaaagggattcagcttgtgaaaaaacatgacaaccacagccaggatggcccctaactgaatcaccaccagaaacacgtccttaaacgcgtccggctggttcaggcgtatgatttcatccaccagaatcatatggccggtgctgctgataggaagccactccgtgaacccttccacaattcccaatacaatgatttttaacacttcaactaaactcataaattctccttaccgcagacaggctccattccctgacgccttccggcatccggcccctgcattcatcctgccccaagggcccctgcctgctgtacattttatgtattcttatctatccctatacctgttttatatattctcaatctgccattcaacaggagtaaggccgtgctctgtcaaaaatgcattggtcttgctgaagggcctgctgccgaaaaatcccctggatgcggacaagggacttgggtgaggcgcctccaggattaaatgcctgggattgttcagcattgccttcttggcctgggccggacgtccccataaaataaacaccatgggtctgtcctgctggttaagaatgcctatggctgcatctgtaaacttctcccatccgatgtcccggtgggaattggcctggtgggctctcactgtgagcactgtgtttaacagcatgaccccctggtcagcccactttttcagataaccgttattcggtatataacaccctaaatcgtcgtgaagctcctggtaaatgttcaccagtgagggcggaatatccacatccggctttactgaaaaacacaggccatgggcctgaccataattgtggtaagggtcctgccccagaatcaccacctttacgtccgccagcggtgtaaatgcaaatgcgttaaagatatcatccggttcaggaaacacccttttagtctcatattcatgctttactgtcttatacagttctttataatagggcttcttaaactcgctgcttaagggccccagccagtcattggtaatagcggccatatcctgcttctccttttcaacaatataaattcacattttcatattttagcataggaaacggcaggaaacaacggatatcgacaaaataattaagagagccgggattgcgcccgccctacatccttacggcaatccctctctcccacaagtacttcttaagatcccgtatctccagttccttataatgaaacagagaggcggccagggcagcgtccgctccgccctttgtcagcgcatcatagaaatgttccttatttcccgcgcctcccgaggcaatgacaggtacggatacatgggatgctatgagagaagtcagttcattgtcatatccgttcctggttccgtcgcagtccatgctggtgagcagtatctctcccgctcccagacggtctgcctccatggcccactccagggcatctgtccccacatccacacgtccgccgtgcttgtatatgttccagccctttccatcagccctgcgcctggcgtctatggctaccaccacacattggcggccgaacttatccgccgcgtcactgataagacggggattgtcaatggctgaagaattaatggatatcttatccgcgccttccctgagaagcatgcggaagtcttccactgtacgtatgccgccgcccacagtaaacggaataaaaacagtctccgccaccttgcgcaccatgtccaccacagtacggcggttatccgaggatgcagtgatatccagaaataccagttcgtctgcccctgccctgtcataagccgcggctatctccaccgggtcccccgcgtcccgcaggttcacaaaatttacgccttttaccacccgtccattgttcacgtccaggcatggtatgattcttttggtaaacatatcgcctctcctatctcctgttttaattggtatggcgctgcctccggtatccccgttcagacagcgcaggacttttacagtccgatgaaattcttaagaatggcaaggcccacctctccgcttttctccgggtggaactggcatgcaaacacattttcccgttcaacggaagcgtggattacggtgctgtactccgtggaagctgccacaatggcctcatcctctgccttcaaataataggaatggacaaagtaaacataggatccgtcctcaatcccgcgaaacagctttgcctccggccttatcttcagtgaattccaacccatatgcggaatcttaagtccgggatgctccggtatcttaagtatccttcccggaaggatgcccaggccggcagccccctggcactcctcactgcccgcaaatagaagctgcagtcccagacagatgcccagaaacggagttccctggtccactgtctcatgaatcacatccaccagaccatactgctccagctttcccatggcatcgccaaaggatcccacccccggcagaatgaccttgtccgctttgagtatcgttttcctgtccctggttatgacaggtgtttcccccagtgaaagcagggctttttccacactgcgcaggtttcctgcgtcgtaatcaataatggcaatcatacattcaacctcgttcctatgatttaatattttagcattgtaacgtgataaaggcaacttgtttttataatcacttaaatatctgccagtccgcggataaaggcaactgaatctgcctggattcccgcggcccgctctcccgtttccttgggtatctggaaaaaggtttcatgtatcctgtaaaatactgatttctggttgaaaaaacctatcttctcaaatggccaccgcataacggtaggtgtcttaaatccctctcccagttccaggataaccagcctgcggttcagggttcctgtctgccatttcttgtatgcctcccaccttggcaggtagccttcctctatgtaagtctctgcctcaaccgtattgcctgtcaggggtgccctgcaatgagggcagatatcatccggcacctccccctcttcccatatatccttggtacaggctttggaacactgcctccaatggatatttccgcagggagccaccacccgcctgctgtcaaaatccgtgtcatagacagctccgtctgtcacagtggtaaccacataatagtccttgtccctgaccaggctccacaggaccgcgtaagcttcccgcagctccttctgtaccggatcctccagactgcgcaggcgcacatctcttccgtcatcccttaatctccattcccctccgatgcctataagtaccttttccgcgccggaaagcgcctctaacaaatccttcttctgctggtccatatccaatcttcactcctgtcattcataaggctgtccggggacccgtgtacctctgatattccgctcctgtccccggcgccgtcttatgctatcatatcataaaatagggcgggcttcaacgctgcctaatcccgcgggggacgggcagaaggatgggcagacagctcttcccggttgcatttttgccggacctgctataaaatatagaaagcaaatacagaaaaaggagcctgtcaaaagccaggccggaatgggattccggcctggcggcgcaggtgaagaggtgaagcatcatcatgaaatcagcacaagacctgagacgattactggaatccattgaccggaaagggtatccggcctataaagatacgcggggttcatatgattttacggattatgtactttctatcgaccatgtacagggagatccctttgcgtccccttccaaattaagtgtatttattccgctccagagggccgcctaccccagcggatattttgacgccccccacaagcagactgccctggaggattatctggtcaggcagttctgccaggagatcgccaaatacaattttaaggcaaagggttccggcaaaagcggcctgatagccaccagccatccagggcctgagattctcagccggacagcctgcgaatgcagtattaagggcataacggcccgctttgaggcaggttttccggccaacggcaggaccattaattccggtgaactgattaagatcctgtttgacttcctgcccaggtgcgtcaaaactgtattttactataaaaacaggccggcccaggaggtaaaggccgtgtcagacctggcggaagaccagtatttcatccgttgtgagctggaacgcctgggacttgtctcctttgtggcagacggctccatccttcccagggaaagcggcatttccagccgtcccatgaagggcagcgtccccttccagtctccggattccctcaggatggaattaaaccttccccatggcggcagaattaccggcatgggtctacgcagaggcattaccctgattgtgggaggcggatatcacggcaaatccactctgttaaaggcactggagtccggcgtctacaaccatgtggccggggatggacgggaatatgtcatcactgattccactgccatgaagctgcgggcagaggacggccgaagcgtccagaatgtggacatctccctgtttatcaacgatctgcccaacaaaaaagacacccgctgcttctccactgaggatgccagcggcagcacctcccaggcagccgctgtcatcgaagggattgaggccggaagccgtgtctttctgattgacgaggacacctccgccaccaacttcatggtcagggatgatctgatgcagaaaatcatcagccgggaccaggagcccattaccccattcattgaaagagccagggatttgtatgaaaaatcaggcatttcaactgtcatggtggcgggaagttcaggcgcatatttctatattgcagataccatcctccagatggactgctatgaaccactggacatcacggataagaccaaggccttctgttccggttacggcgttgagcccatcacctccgcccccggctttcttcttccgtccggcgggcgcagactgttaagcaataagggcggttcccagactgctccgggaaattatgtctcatcaaacagggggaattacaggggcagaggcccccgcgacggcggccgcgacgagcgtatcaaggtcaaggtatacggaaaggattcccttcaaatcggcaagtcccctgtggacctccgattcgtggagcagctcattgactctgaacagaccaactccctggcacagatgctgcgctactgtgtggaacaccagctgctggaacggtacacgctaaaggatacggtttccatgctgcttaaggagatacaaaaaggcggactggcagccgttggagacagctcctatgcggcctgcggcttttccatgcccagaatccaggagattttcgcctgccttaaccgctaccgcaattagtttctgccaccaaccataatggttttataaaaacagcgcttccgctgcctgcaacggcagcggggcgctgtttccttttactttaccgctgtttattttctttttctgcttcctctaatattccttcccgtccagaatctcctgataatccttcaggttcttctccagcagcgcgggcgtgtccaggttatagggacattttcccttgcactggttgcagtggagacactgttcaatcttcttcattttctcctgtgcgtccggtgtcagccaggctgcggaaggagctctgcgtatcataagggacatcctggcacagttgttgatttcaatgcccacgggacatggcatacagtatccgcagcctctgcaaaattctcccagaagctcttccctgtccttatcaatcactgcccttatctcgtctgtcatttcaggaggatttcccacgtaagacaggaattcatccagctcccgctctctctgaacgccccagattggaagcacattgtcaaactgggccaaatacgcgtaggctgcccgtgaattattgataagaccgccggataatgccttcatggcaatgaatcccatgcctgcctccctgcaccgtttaaccagctccagatccttatccgtggccagataacagaatggaaactgcagtgtctcataaaggcctgaatcaattgcctccatggccactgacagcctgtggttggtgattcctatgtggcgtaccctgccctgctccttagcctccagcatggcttcatacagtccagtgccatctcccggctttggacagaaggaaggattatggaattgatagagatccacatggtctgtcctcaggtttttcagggagatttccaaatcctctctgaatttctccccagtttttgcggctgtcttggttgcgacaaacaccttgtcacgtattccctcaagggcggcccccagcttttcctcactgtccgtataattcctggctgtgtcaaagaacgtgattccgccttcatacgccttttttatcagatatacggcatcttccttcggtattctctggacgggaagggccccgaacccatttttgttcaccgttatacctgttttccccaaagtaacttccaccatcttatgtacctccttcaagcctgctgttttttattattctaccataaaactgctgccatctacaacagaaggactcaaacaaacataaaattgtacgctgttttgccccacgtcccgtatatccggcgggttggatatcctgctggtaaacacactgtttccacattcccggatttgtgatagaatggataaaacaaagcggcaaacaagaatgtctttggcagatacgccgggaacgggtgattgaacgcagcagggaggttaagcgatgaaaaagattgggattctttgcgccggcgatacggaactggccccttttttagaacatatgaaagggcagcaaattacagaaaaggcaatgcttaaattccatacgggaaccataaatcatgtgaatgtgtccgccgtatacagcggcgtctgcaaagtaaacgccgccattgcggcccagcttttgatcgatatgttccatgtggacttaatcatcaacgcaggaaccgcaggcgggatgaaggaaggggtgcagctttttgatactgtgatctcggaacgggtgatttaccatgatgtggccgatgatattctgacggactttcacccatggctgaaatcaaattattttttagcagatcaggagttgtgcgccatagccagagcgtatagccgaaggtcaaaacaccctgttctgtttggaaccatggttaccggggagcaatttattgaagatgaaaaaagagaggaaatcaatcagaaatttgaccccctctccacagacatggaaacggccggcgttgcccatgtctgctatgtaaaccgcattccatttctggcagtgcggaccattacagataccgttacgcatcagggcatcgaaacctttgaccagaactgcgaagcggcctctgaaatatccgcggagattgttttaggcattcttgggcaattagattaggaggtataagggcttatgctgatacaaaatgggcatcaacaattacaggactttacgaataagaactatgaacaaaccataactgaagtgacaaagggcgtatggtttgttttgggattgggacacagcaacgccatttttattgaagcgggttccagcgttattttgattgacacattggatacacgggagcgcggggaaaagctgctggacctgatccggcaaaatacaaaaaaagaagtcggtacgattatctacacccacggccatcctgaccaccggggcggcgcaggagcttttatggatagcaggccggagatcatcgcctttgcgccggcggccccagccttggaaaaaaccgggcttttacaggatattcaaaatctgcggggggcacggcaatttggctatccccttaccgaccaagaagcaatttcacagggcatcggtccccgtgaagggattacccacggtgaacaccgtgcctttgttttgcccaccactctttatgaacaagacaaggtaagccgtgaaatcgacggcgtacagttggaaatggttcgtctccccggagaatcggaagaagaaataatgatttggctgccgcagaaaaaggtgctgtgctgcggggataatttctacggctgttttcccaacctctatgcgatccgcggagggcaataccgtgatcttgcggcatggattcacagtattgacgtactgatgtcctatccggctgagtacctgctgccgggacacacggcggcgattctgggacatgaaaccatcagcagcaccttggggaatttcagaaatgcatttgaatatattctgacgcaaacgttggatggaatgaacgcgggaaagactgcggatcagttggcggctgatatacaattaccccccgaatatgcaggtcttccctatctggcagagcattatggctgtgtggaatggacggtacggtccatttactcggcttacctgggatggttcgacgggaaccccacgcatttgcaccccctgtcccctgaagaacattcacaaaagatgattgcgttaatcggcggcgtgcagactgttttggacgcggccaaaacagccctttcccacaaagaataccaatggtgtctggaactatgcgatttacttttatccaatgggaattcagcaaaagaggaagtattgcacttaaaggcttcctcgctggaaaaactggcggagtacgaaaccagcgccaacggacggcactattatatggtatgtgccaaagaaataaacccggaataaattccaacttttttctgatatgtaatcaaaacgggcaagtacagtatgggcttgcccgttttgtctgcccattcagcaggacatgggctttctatacgccctgtctgatgctgaaaccagccctgggcctgcggcagcggtattttcacggcaacgccgacagagcgtataatacgcttaattcgcccaaagccgtgtgccaaagggtgccccgtgaaaacccattccgcctgccggctgcccaatctgaatgtttcccaaattaccgcttataccggttttcatgtatcatgcgctgagcgtcacgtcccctcctgccagcatttcttttaaatcatctatggtcatgtcccgttcctttaacatctcgttgaccaccttaaattcctccagctggatatgttccatcagtgccttttccttttctctcatggtttccagacagctttcatactgtgctatggatgcttgtacatccgccagctctccctgcattttttcaaccggtgactttcttactccccgtgccataaacgtgcgctccttttctttttgataatatctggtctgaatctgcttccgggtatctgttcggaggacaggtccatttattaccagtatatgtaagcaaatttcaaaatatacataagcttataaaatcctctccgggtttaggttcgctgtcccgggtcaggtaagctctccttgcagccggtaaatcaacgaaatcatccaaagcccggcagctttggtaagccggacaaaagggcagccgcagagggcagataacgagaggcccatgcaaacatctgtttccgcctactcgtcttttggaaaatttcatggtataatacttccatgacttccatgtgccgccatattgccggaaaggaaaacaataatgaatgagactgataaagggcctgatgtatgccaaaaccaaaacgaaggattggacgaaacccagggagcgccggacggttcccgtgagctttcagacagttcccatgagcttccggatggttcccatgagcttccaaatatctcccctgatccgccggatacctccaacaagcttccggatggaatggagattgatatgtcacactataaagaggggtctgccgctgccaaatgcgtactgggagtgattcttctcctgtgtttcatcttcatgtccaggtcctgtaactccagacattcaaccctcaccttttatatgggtccggagccggaggttaatctgggaagccagtattacgaggaaggaagatatcaggaggctgctgattattaccaggaaaaggtggacgaagttttttcaaacggcaagcggtatgaaccggccaacggtccgctctattttaacctgggtatggcatactataaactggaaaactatgaccaggcccttctttatctgaaggagtgcgcggatgtggacaagaggacttccaatacagaagaactggcatgggattataacaccatggccgacgtctgtaaggacgccggccatatggacgaggccctgaactattatgaaaaaggtctgaaggctataaaaaaggcctgtggaaaggactctgagtatacagccatttttctatccgatttaggagacgcatacaagaaaaccgaggactatgaaaaggccctggagaattatcagcaggccctgaagatccaggaatccaatggaagcgaccagacctggtcctacatccgtatagcaaggatttataatgctttaaaggattatgatgccgcagaacatttttatggcaaggcttccgggtcggaaacagccgactcctacacaaaaggggtggctttctacaatatgggacagatgtaccatgagcgcggagagtattctcctgcactgtccgccctccacaaggcgctggagtctattaaccaggatggcgacaatgcctatgctgaatccaacgtccagaataccctggcttccgtatacgctgaatcagaggacagtctggacaaggctatcgtgcattctgtcacggcatgccgtctgctggacacatccggattccccacgcacaactgccgcgaggacctggaacaattcaaagaacagctgaaaggctactaccagacagataccagggatatgacagatgaaggatttgaattatggtatcagggtcaaatggattccgaataaaaccaggaggtaactatgtttaaagactacgaacatcacgcacagtattacgagaccgatcagatgggctgtgtgcaccattccaactacatccgctggatggaggaggcaagggtaaacttaatggaacagataggctgcgggtataaggccatggaagcatccggcatcatgagcccggttctggaggtgcactgccagtacaggtccatggtacgttttgatgaccatgtaaggatacatgtatgggtaaaagaatataatgccatccgcatgacccttggttatgagatgcgcgatgcagccaccggtgaactcaaaaccaccggcgagagcaggcattgtttcctggatacaggcggcagacctgtatccttaaaacgttcctaccctcagtgggacaccgcattctgcagcgcggtccaggcgcaggattcccggtaatgacggcatctgtaggcgatgctgttatcccaagggattatcctcacatgtatatatgtaattattaagacaggaaggctgactagtttatgacaaaattaaagaatatccgaattttgataatatccattttatgtgcaatatcgcttttgctgggaggatgcgcggattcctccccctctttttcaccggataagggttcatccataaccgcgccatccggttttggactggctgtgcattatattgacgtgggccagggcgacagtatactggctgaatcagacggacactacatgcttattgatgcaggtgaaaatgaccaggccggcactgtaatctcttatctaaaagcacagggcgtaacaaaactggattatgtaattggcacccatccccactcagaccatatcgggggcctggacaaggtaattgatacctttcccgttgacaaggtcattctgccacctgtggagcacaccacaaaaacctttgaggacgtacttgtctccattgcctccaggggacttaaaatcacaaaacccacccccggggattcctatgatttgggagacgcctccttcaccatactctcccctgtaaaagactatggcagcgacctgaacaactggtccgtgggcgtccgccttacttacggcgataacagctttgtcatgtgcggtgacgcagagaaacaggctgaagaagatattatcaaaaacggcgcagtgctaaaagcagatgttctgaaggcaggtcatcacggcagcagcacctccaccagtgacgcatttctgaaaaaggtatccccctcctgggtggtaatccagtgcggaaagggcaactcctacggccatccacataaggaaaccatggaaaagcttacgaaggcgggctgccaggtactgcgcacagacgaggagggaaccattaccgcattcagtgacggcaagacaattacatggagtaccggcactgccgcggttcccggcggcagcggcggcaatcagaccgccgctatcccagacactgacaacggggccgcagctgaaaatgagaccggcgatccctccacacgctccagctatgtcataaataccaacacaggcaaattccaccgccccgactgcgcctctgccacccagatgaaacctgagaaccgcaaagacgtgacagcatcccggaatgaactggtacaggaggggtatgaaccctgtaagcagtgcaagccttaaaccaaacccacagaaaggatttttatatgaaatatatcatcgaccggctggaagagggtctggccatatgtgaaaccgaattaaggaaacgcatctctgttcccgtcagccatcttccaaaggaagttaaggaaggcgacgtgctgagagaagaggaaggcaggtttttcctggattccgaagaaacagataaaagacggcgtgaaatgaagaagaagcttatggatctgtttgaataaaaacaaaaaatgacaaatgaccgcgggcccgtattgactattccaatgggggcccgccttttctgttatgctcctgttatgttacccgttatactcctgccatacttcctgtcgttcttgccatacttcccgctgtccttcctgtcatacttcctgtcatacttcctgccgtacttcctgtcatactaccatccattcatccataccctacctgttatccggcgatatcattttcccgtcctggtcaaaccggtattcctttccatcaaccacgcaggttcccacggccatcttcccgtctgttcccaggtaatagagagaaccattttccccgtaccatccggtcctcatgtttccgtcaccgtcaaacgagtaccatacgttgtcaatctgcttccagcatccaatcacacgggttccgtcctcgcagatatagttccagtatgccccattctgatgccagcccgaagtaccggaagcttctcctgccccggaagctgtccgggccgcagcctggtcctgagtctgggtctgagtctgcgcctgggccggtgcctgggtcggtgcctgagtctgggcttgtgtctgggtttttgtctgggcccgggtctgggtctgggtactttccccgcctcctgcatagggacacactccattgggatgcaggtgtgccggatgacctccgcagtggtaatgatagcttcccagcccgctggcgttcttgttatcccggtgtcctccgctggcatcggttctgcctgaatgggcctgggcctccattccccacggggcctgtcccgtcattgccgcgcctcccgccagaagtactccgctcatgactgccgccagccatatctttactgtacgtttcatctcattacctcccgatttcatttttaactctattttaccatgtttttatctgtgtgtaactccgtatttcagcatctttccaggggattttctcattttcaggccatttccggcataaaaaagtgatggaagcacttgcacgtttttcccaatgatgataccataagaaacatatgtaatgaattcaactagtttggaggtttttaaaatggaactaatcatacctaaggattacgatccccgcctctccatacgggagacccaggacgcaatcaaatacatacgcgataccttccagaaggaaatgggcagggagatgcatcttgaacgtatctccgctcccttattcgtggaaaagagcagcggacttaatgataacttaaacggcaccgagcgtcctgtctcctttgatatgctggggctacccggcgaaaccctggaggtggtgcattctctggcaaaatggaaacgtatggccttaaagaaatacggctttaagccgggcgagggactttacaccaacatgaacgccatccgcagggacgaggagctggataaccttcactcctgttatgtggaccagtgggactgggaacgtgtcattacaaaggagcagcgcaccctggacaccctgaaggatacggtgcgggagatcttcaaaattatcaagcacatgcagcatgaggtgtggtataaatacccggaggctgtcaaacatcttcccaaagatatttactttatcaccagccaggagcttgaggacctgtatcctgataacactcctaaggaacgggaaaacctgattaccagggagcacggctgtgtgttcctgatgcagattggcgacaaactggccggcggcaagccccatgacggacgtgcgcctgactatgacgactggaagctgaacggcgatattcttttctggtttgagcatttgcagtgcgccctggaaatctccagcatgggcatccgcgtggatgaggctgccctggaataccagcttaagaaggcgggatgtgaggaccgccgcagccttccctatcataaaatgcttttaaacggccagcttccctacaccattggcggcggtatcggacagtcacgtctgtgcatgctgcttttagaccgcgctcatatcggtgaagtacaggccagtatctggccccaaaaaatgcgcgatatctgcggggagaacaagatttatctgctgtagccattggccgggagcgtattatggaatcgaatatctcaatcttttttatcatcgaaataatcggtaccgtggcctttgcgtcctccggtgccctggtagccatcaaacagcgtctggatctgctgggagtggtggttcttggcgtcaccactgctgtcggcggcggtatgctcagggacatcctactgggcatcgtaccgcccagcctgttcatgaacccggtttacgtgtacaccgcctttctcacggccatggtgctcttcatcctggtgtggctgaaccagcagatactggaaagccggtatatctcagcctatgagaagatgatgaacctgtttgatgccatcggactgggcgcattcacagtcaccggcatcaataccgcagggacagccggttacggggaatatcatttcctttccatctttctgggcgtcctcacaggcgtgggcggcggtatcctgagagatatgctggcaggccagtccccgtatatcctgcgcaagcatgtgtatgcctctgcctctattgccggggccgtgtgctatgtatgccttaacggctggctctccagggatgcctccatgatattgagcgcaatcctggtggtgctcatccgccttctggcgaccaggtacgactggaaccttcccaccgcataccatactaagaacaaataaatgaaacaagtccgggccgtaatcattgcacaaaccagtgtaacgatgattacggcccggactttctttccatgcgcttgtattgctcttataaaacatgcataaagctcacctctgctgctgtaaatacttggtaatgcttctttggaatatcttcatgctgctgtccacgttcctgttttccatgagtatctttgatatttcaccgtccgccaggctcatgacctgctcatactgctggtatttaggctctatgaccccattttcaattacattataaagcaggctgctgttgataacctgctcgccctcgtccatgtcctcctgtataatggcagctgcctgggcggatccggtaacgcttttaagcaccgacactccctgggaataccggaatatgtccatctgcatctcttcatttcccgtcagctgtttcagaaactcccacgccagcttttcatgctttgtattgctgttgattcccatgagaagggaatcaactctggaacgattttccccctccttgcccgcgggaaatgtgatgcagtcccactggaacctggtatatttcttaatccggtaaggatatgttttataggtcctgtactccgcaaaggtcaggggcatgaaagccacgttccccttgttgaaatcctcctgggtcacgctctgtccctggttcaggtcattgaggcgcttcatgtatttaatggcatccaggacatgggagtctgtaaagggaagctgctgctgatccccgtcataaaaccttcccccgctggtgtaaaccgcatttctccagctgtaattataggttccgaactggtccagcagtccgtctccgtttacatcctttgttatcttacggcagatttcatacatatcgtcccaggtccagtcctcccccggcacctcaatctgctctttcgccagaagggacttgttgacaaataaaaggacgggaaccgtttcataaggaagggcgcactggtgtccgtcgtactttcccgcatccagggcagtagtgaaaaaatcattccggttaaacccggcgtcgtgttcaatgagctcgtccaggtttttcatgactcccagggatgaatacaggttgaaatccgtgtccggcaccataaacacgtccggcatctttccctctaaaagctttctggcgcaccactccgagtaatcctccttgctgattccgctgtagtaatgtatcctcaccccgggatgctcctcctcgaactttgctatggccttgtctatcatgacaaagctgctggcactggccacatcccagttgcttcccgtgaacatgccgaattccaggacaatctccttctcatggtacttatatatacatccaaggaagcctgcaaggaggaacacggctgctcccaaccccagtgtccatttccatcccttcatcccaatctcatccttccttctgccagcatcttgacctctcccgatccccgtacactggtccggtcaaatctcatgtgcccagccgctttctcacgttggtctggacagcccagatggccagctgggtgcggtccctcaaatccagcttgttcagtatagtgctgagataattgcgcaccgttccctccgacagcttaagggcttccgctatctccttgttgctggcccccatttccacctgggctatgatcttccactctgtctttgtaagctcgtccacattcttatcgcccacaagtatgctgtaatctgcctgggccatctgcgaaaacagcctcagcaccttggttgcaatatccgggttaatcatagcccatccattgtataccgtggtgatggcattggccagttcatccatggacacgccctttaagagatatccgctggcgccatatttcaaagcattgtaaacgtactcgtcatcatcaaaggtggtgagaataataatttttatctgaggataattttccttgatgattttcgtgcactgcacaccgtccagcttgggcatccgtatgtccatcagtatgacatcgggtttattcttcctcacgctgcggatgacctcctgtccgttggaagccacatccgtaaccattatgtccggcctgctgttgagtacaatctgcaggctctggcgaatcaattcctgatcgtcggctatcaatactttaatcataagtctccccccatcggattggtattcttgcattaacagtaaatccgtcgctgccgtcaaatgtaacaacgccgctcagcatcttaatcctctccttcatatgctttgttccgaatccgctttttatctccttgcatccgattccgttgtcccttatttgcagaaggatgtccgtatcctccttctttatggtaatccatatctgactggcatgaccatggcgcagcgcattggtgattccctcctggataaccctgtaaatggcattttcctcgtcctcgtcaaatttcaggttctttacctggcagtcaaaatacacccttgcgccggacacagcgttcatgtcagataccatcttgctgatggcatattccaggctgaagcgctccagggcgtccgggcgcagctgactgactgagcgccgtatttccttaataccgtcccttgtgaccttggaaataagctccagctggtcctttgtctgccggggcgacgtgcctatggtagccaggcaggcgtctattcccgcagcaattccggtcagggtatgccccagggtatcgtggatttccctggccagacggtttctctcccgtgtctcggccatcttttccgccatcacggaatactcctgaagctgctcattcacatcctgaagctgctcattcagggcgtgtatctcgtccagatttccctgctgctggttgataatgttcacacagtacaccacgaacatgattacattcagggataccaggatattatagctgctgagcagatactgctgggtggttgcattgtaaaatgaaatataatcctgtatggaatacaggcggtatgaaatggaaagcagttcgtaatcagccagtataaaactgccgattgccactgccgccagaaaatacctggatttcccgttcttggcatagagaatgacattggaaaacaccagcagcagaattccgttgtaattaaaattcaaaagtatgatgatggcaaaacatatggcaaaatcagccacaaggctgaaaagaatcaccttgctgttgtccggaaacagccggtcccgcacaaacatactgcctgccagaagagccagaaggagggcgcagagccagatgttccggtaaggataccagacaatggcctggacgccgcttaaaaactccctggccacatagctgcgccgtatattttcaattgtggcatatataaatatgctgagtcccatgacagataccacattcagcgccagaatgcccagctgcaggatgcgtacccgcctgttatccatgttcgtatccatcttctcactgccacccgtctatctcaaactcatggaggttatccctcgtaatcatggtgctgggcaggcttatgtatttctccaccggctccccgtccaggtaacggtatgcggtctcagccgccttccttcctatggaccttgggctctgggcgctggttcccgtcacatagcccacatccaggattgccttgaaatccggagagccgtcgattccgtaaatcaggacgccctcctccctcctggcctgctgcagggctgccagagcccccagtgccgtggggtcattgcctcccaaaatcacgtcaaagctgatgtcccggcgcagcaggtcggccatcacatgggaggacacctcaatctcgcctgccgcagcttccctgtataccacctggtaattgtgattatccgctatggtgtccagaaagccctgttcccggttggtaatggaggtctggatggggttgtcaaggatgacgattttagcctggtcctttcgtttcatcatatccagggcgcagagctggcccgcctggtaattgtccgtttcaataatggaaatcacggagtccctgtccttcaccaccgtatccacattgatgatgccgactcccgcctctctgcacgcatccagggccggctgtaccttttcccagtccacgggatttaaaaacagcatctggatgccctcgtctatcatttcctgaatctgttcattctgcttttcctggtcctgaaggggatcccgggtaagcaggatatcgccgttggcttccaccacctcttcaatcccctcattgagtacatcaaaatacggattattcctggtcatataggtggccccgaacagcctggcctcatgctgtcgcccgcttgtgtccccatggccgcagccccccagcaggagcatggcgcccgctgtcaggattaacagacctgttcctgtcttcatctggttcccgcctccctattcttggcttaacttcccggctgccggtcatattcccggctgtccggtcatgccccggctgcccggtccttccccattatacctcaaacatgggcatctgtaatatttcataggaactttttataaaactttggcttcgacaaaaagcgccccactgccgtgaaacgcttttgccgtaaaccaggctctattccgcctttttgtttctcaggtaatccacaaaaacagccaggagaataacagttccctttaccacgtactgccagaaggaatttacattcagcagattcagtccgttgttcagcacgccgataatcaggccgcctatgatggtgccgccgattttaccggagccgcctgccatggaggtgccgcccaccacaacagccgcaatggcgtccatctcggctccgtctcctgccgtcggctggccggaatacatacgggaggccagaaccacgcctgcaagtcccgccatgattcctgaataggtatgtaccaggaattttaccttggccgtgctgatgcctgagaatctggctgcctgggaattgcctcccaccgcgtagatatggcgccccagctttgtcttattcatgataatggccgtgataaccagcaccactgccagaagtatgacaggagtggggactccgcccacgtacccggctcccaaaaactgccattccttagtaaccacacgcacaggtgaaccgcctgtatatacataggccagtccctttgccacattcatggtggccagggtcacgataaagggcggtatggttgtctttgatatgacaacgccgttaaacatacccaccacagtgcccaccagcacgccgcccagtacgcccactgcgattggaaggccgtaacgggacacgcagccggctgcaaagcagcctgaaagggcgataatggatccgacggacaaatcaatgccccccaggataatgaccatggtcatgccgcaggccaggaacaggttggatgatatctgtctcagcacgttgaatatatttttctgggtcagaaaggagccgctggtctttggaaacacggataagaaaatacacaaaataagcagggccccgatgatgccgatattatccttgaaatattgttttacatttttctgcaatctggttgtcatttgactttcccccttttcttactttgccgccagcttcatgatttgttcctgggtgacgcattcctcatggctgaagcacccggttatccggccgtcgcacatgacatagacccggtcgctcatgttgagaatttccggcagttctgacgatatcatgataatggacacgccttttttcaccagctcattcatgattgcgtatatctcagacttggcgcccacgtccacgcccctggtcggctcgtccagaatcagtatcttgggggcggtggccagccatcttccaatcattaccttctgctggtttccgccggacaggtttccgataagctgttcctgggacggggtcttggtatccatcatctcgatatactgccgggtaatctcctcctccttgtccgcatccacccagatgccctttatgaagctcttcagcacctcaatggtggagttgaaccggacgctctgtaccttatacagtccctcctgcttccggtcctcaggcaccagggcaatgccgaacttcatggcatcaataggagatttgatggacgccttttttccatccacgctgatttcaccggtacagccgggcgtcagtccgaagacgcacttcatggtctcgcttcttccggcgcctaccagccccgcaaaaccaatgatttccccctcacgcagttcaaagctggcccctttgaccatctttccgtctgcaatgttttcacattttaaaaccacccgtccgggctccatgtaatccctggtgtaatacttggtcagctcccggcccaccatcatggcaatgagatggtcccttgtggtatccttcaccttctcggtgcccacataggttccgtccctcagcacagtaacccggtcgcagatctgctccagctcatccattttatgggatatatatatgattcccacgcccttctttgtgagctctctcatggtgctgaacaaaaattccacttccttgtccgatatggatgaagtgggctcgtccatcacaagaatcctggagcgataggaaatggccttgacgatttccaccatctgctgctgggcaatggtcaggtccttgaccagcgtcccagcgtcaatgctcatgtggtatgtatccagcagctgctgggcttccttttccatggtctcatggctgacccatagcccctttgacggctccctgccaagaaagatattttccgccacagtcatgtgaggtaccagtaccaattcctgatggataatggaaattccgttgttgtgagatgcattaaccccgtcaatggttaccttttttccgtcaataaaaatctcgccctcttctgcgatgtagatgccgcccagaaccttaatcagcgtggatttacctgccccgttttcaccgagcaatgcgtggacctcgccggccctcagttccaggtccaccccctgaagcgccttgactcccggaaatgatttgtggatgttcttcatttgaagcagaactgtttcactcataatctcacctgcctgttcttctattcatatggttcctgacagagtttcctgccgtgcttttgcgttttgagcctgtcagataaaaagtgcctggcccccgcaggggcccagcacttttcagactaatctcttactgccatccatctgtgccatacttatctacattttctgatgtaataaggaaggtttctaccggatatcttgattctaccttatcgccgtttaagtatgtatacatgatattcactgcggactgtgcaatcttaacaggagactgtgcgccgcttccttctatcagggattccccggaagccatctctgccttgatgtcaggagagccgtccacgccgtaaatcatacagtctgtaaggccggctgcgttggctgctgccagtgctcccagtgcagtggggtcattacctccgaaaatggcaaccacatcgccgtgagcctgcagaagatcctctgcaatacccatggaaacttccagattgcccttggcatcctgctgtgcaacgatgttaaagccttttccttcaattgcatctaaaaatccgtttgtcctgtccgtaacagagttcatggtaggagaatccagtacaatgatatccccgccgtccgggcatttctttacaaggtcctcgccgcagaccttgcctgcgttatagttatcagaaccggtgtaggaaatcaggtaggacaagtccgctacctctgtatcaaatcccacgatggggattcctgcttccttaagctgatccagggccggaaggattccctctgcctctgccggattcatgaacatggcatcaatgttctgggaaatcaaatcctctacctgggtaatctgaagagtaacatcattggcgggatccactgcaatcagctcgtcgccgttggcctcaaccatttccctcatcctcttctcaatggtgacaaagaacgggttggttccatccatacaggtataaccgaatttgtaatgcttgtccgggtccttctttttcacatcagcagacgccatatcggctgctgccggagctgccgcttctgtggcttccttgctctcctctgccttctcaggctcagcggccgcctccttggcttcctctgtggtctgggcctgagttggcgcctcggtggctgctgccgttgtctgggagtccccgctgctgcaccctgccagggcagaacctgccattgctgcgcacatcattaccgccaacagcttcttagtactttttttcataagttacctccttttgcaaaatgttttgttgtttttgctgtaataaaatcttaccacgcttttctttttaacacatgtgcacaatgtaatcattttcatatgacatttgtcatatttttcatcatcacttttgccctttcccgttcagccgccgcaaattttcatcgttttgcacaactgtccgctgcgggatactcattgcacagcagacggaagggcggctcatcctcctctataaccggaaaacggcctgccggcagatagaaccggttgtcccggttatcgtcattacacatggatacctcgcccaacagaaccggccctgtgcccggctccaaatggaagtcatgatacagacagggctggatggtaatgctctctccgggacacagccgtatctgcgttcccgcgggaaccgtgtactcccgcccgtcactgtgtatccgcacatccgtgtcagccagcccctcctccctgccggcattatatacgcctatgagcacattgcctcctcccctgttgatgatatcctccatcttattccagtggaaatgcatggccgcagactgtccttccttcatgtacagcagcttttccgcatagggtttcgtgtacttatccatggacacattgccgtttctcagggtgatgagggagaatcccaccttgtcaaaatcccccattccaaaatccgtgatatcccatcccagcatgttgtcccggacctcatcgtattcatggcccttttcgttccattcttccggtgtaaaataacagaacgggggcagtttaaaggagcatctgtcaatcatcttttccatgtccctcaatgccctgttgatttctgaacgtttcatggcttttcctcctttgccgtcttactccagatgggagaacaccctgattgtgtggagcacatcctccttcatggcctggaccgcccactgggttacatcgtggaaaaacacatattcttcggctgccctgcatttttcctttacatacatgccgcccgccttggcaaggtacgtgtagtaattgattttcctgaccccgttggcaatgcatttcttaaaatcttcgtcgctgaccccggatccgccgtgcatcacaatgggaatgccaatgctttcccgtatcctgcgtatcctgtcaaaatccagctttggcgtggtcagatacagcccgtgcacggtgccgaatgagcaggccagggcatctatcccggtaagcccggtgaacgcccgtgcctgttccgggtccgtatagcagctctccacggcctccccttcttcgccttctcccacacttgagaattcctgccttcccatggctccaatctcagcctccacggaagcgccccagtctccggccatttccaccgcaatccttgtgtttgccgcattttcctcaaagggcagaacggagccgtcatacatcactgaggtaaatcccatttccagggcttccctgaggatttccagcttatcgccgtggtccagatggacgcatacaggcacagaggatttctctgccatcatcaccatcaccggcccgatgaccttaagagggataatggactcatggaccggcgcaaactgcaggataaccggctgtcccagctcctcagccgcccctaatacggcctgaattccctccagagatgtgatgttgaaggcgccgactgctattttttttgcatctgccaggtctaaaaccgctttcattgaaactaacatgttatatattctcctttcttccggcctgggccgggacatacatggttcttctgcctcttacggaggaagccgcgttttccctatatggcattcctttgtttgaccgcaaaaatcgttttttctatgtcacggatggatgatgttctgcttctcccatccagcttccatcttctgcctcagctcctcaaaggacagcaggccgctcagggcatcgtaggccgtgacgcaggacgcacccgtggcagctgccagacggacgcattcaaggggcccgcagccgtccagcatggcctttatgaaggcggctatgctggtatcccctgcccctgttcctgacaggatgcagtccggcacatagctgtcctcgaaatggctgatatcattccatcctgtaaatcccggcaggaattccctccataccggctcaggcgcggtcttcagatacatgccggctgccccgcatttcaggagaacgcatctggtccccatggacagcgctctggcagccaaaggcttaacgtccttctccagggataatatgcctgtgacatcctcgccacctgccttctcctgccatttgcagtacagaggacggtccagcatgtatcccagctcctcaatgcttggcacgaagaaatccacatagggcagcacccgctccagtatccttgcccagtccatgcctgctgcttcggaatccggatccaccgccaccaggtccagggacgtggtaagccccatggattttaccttcttaaaaagccttaccagctcctccccctcattcagataaaacattcgcataatgggaggataaccaaaatgaaaatgtgatgcctcccccactttttcaaagtccacgtccccgcagccaaaggtatcattgcagcccggatcgtgaaggaaaaaacggtccagtcccttgggcgccagcacaatggtataggacgtattctcaccaggaacctggctgatgcaggtctcacagccatgtacgcttatcatgtcctttagtgcattcccaaaataatcgtcccctattttggccatcagaaccacgtccgctcccagacgtttaagacccaggcctgtgttggaaacagctcctcctgtacacatcatggcctttcccaccttaagcagctttccaggctgaaacagttcagagagcttctgcttcccgctgttttggaaaaccggcgtaatatccagggaaatatgcccggccactgctatctttttatttccttcttccatcttacctcccccttccgcatccaatcataccagttttcatggacaaatccaatgctttatgtgcaattattacataggtaatatttaatatgacatttgtcatgtgcatattgcacaacataaaaaacaaacgtaataaatcacccaaaacgcaaaaaaagccctgaggggccgtgaatttcacggcgcccccagggccttaaggttatttatttaacccgtacatgcagattctattgacactacggattctaatggcactacggattctaatggtacttgcggattctatcgttcaattacactgcttacgcgattgccgccgctgtctgtccccggtcccctgaccactctatggcgtcataggcctgggcaatgttcagcatatgatcgccgattcgctcgtagtcagtcagcatttccgaatacaggatggaggactccacattgcagttgccctcccgcatgcggtcaatctggttctgccggaacttgcgggtgatatcgtcaatcctctgttcaatctcagccacctccgccagaggagactgggcgtccccggcagctgccgcctttaaaagctccatgccttcccggcaggtttcctccatgacagcaaattccttcctggcgtaattggaaaactgaagtccttttgcctctatggtttcggcatactccgccaggttcatggcatggtcaccgattctctcaatatttcccagaatggtatacatccggttcagggtgtcaatatccttgggcgtctggtccagcacaagtatcttggaaatcttctgggacagcctcatattgcttaaatcaatttcctcttcccggtccgcgatggcctggattccctctgcggcgccctcctccacggccttgaagctctgggatacattctctgccgcagttgccagcatccccttaatctcgtcatgaatctggttgatcgcaatggtggagataccaaggtggtgcttggaggccataagcccctcaaaccactggtccgcatcctttacaggaactgccttatccggaagaatggcaatggcaatcttctccagaagggcgccaaagggcagaagaatcagggtggtgctgatattgaaaatggtatggacattggcaatctgagccaccggattatccggagtcaggcttaccacaaagtccgtaaaaggagtcaggatgcacagggtcacaaacagggccgtaccaatcacattgaacatcagatgaatcagggtggtgcgctttgcattgcggctggttcccacagaagccagaagcgctgtaatacaggtaccgatattctggccgaacagcacgaacacggcactgtgaaggttgatgacgccgcccatagccagagcctgaaggatacccacagacgcagacgaggactggataatggctgtgaataccgctcctaccaggattcccagaaggggattggaaaatttggtcaccatatggatgaaggtttcggaatcccgcagcggaaccatggcatcgctcatcatgcccatgccgatgaacaggacgccgataccggcaataatgcctcccacatgctgtacctttttatttttcgcgaaaatcagggacataacgcccacaaaggcgatgagcggagccaatgctcctatgtccagggcaatcagctgtcccgtaatggtggtacctacattggcacccatgataatccatacagcctgcttaagtgtcataagacccgagttgacaaatccaaccgtcataacggttgtggctgaagacgactgaatcagggctgtgattcctgcccccaccagcactcccagaaagcggtttgccgtaaggcgctccagaatctgcttcatacggtttccagccacagcttccagattggtactcatcatctgcatgccgtacatgaacagggccaggccgcccagcaggcttaaaaccaattctactcccatgtgttttctccttttgtccgaggaaatcaactgctgctatattatcattttacggataaccctgtgtgttccggaatgattccgggtaaaaatgggcaaaaatatggcatagcccgccatcccaaacaaacgatcgcaggttatgcctcctttatcatattcttgcggcatccgtcacacagggcgtttcccatgatatctatagcctcttttcctgattatttaccatttctttacgacttctttacacatactcattatacgggatatttcatatgtcgtcaatatcgtttcccgccagtaatgtaaagtctatgtaaattatgtgtaaaatttcttccggaaatacatatatttacaaatctccccgcagcagagccgcaccattatccaattattgagtatattgatttttcctgttattatacatcctcgtgttcccggccatagacctcaatctgcgtcagggcagggaagggggaaggatcgtctgcctttatgagctgcccgaaggtaagccatgtgatacccttgcgctccaggctgatgatatgaggttcaacgctcttttcaagctccacggtctcagaggttccgtcggaaaaggtaaatgtcaccttctcccaccagttgtcatgaggaaaatcagcccttgtatagaggacaatctggtcaaaatccacggggcggccaaactccagcgtcatttgggcatcgtcctgcatattgattccccatgactcatatggccactttccatgggacaggtttgccgtcacaccgtcaatggcgttgcgtgccgcaaacacagcctctcccctggtttccacattggcgtgggcgtggggataacattcctggcccctgtgctggtccataacgttcttggccagattccggtatgatttaatttcataatccctggcataccgcatggtcagatagtggcgctctcctgtaaatgacttggggttataggatgtcttaccctctgcaaagggaacctcataaaccagctcattccccgccccatagataaaggcttcatccatggtatcatccacacgcatgatatagaaacggttcttttccggaagagaaaatataatcctgtctccctcctcatactcacccttccatgccagtacggcctgttccctgcctgcggcctctgcctttaccgcatcgtttttatccttcactgtaatctgcattcccatatatttacacactcctctttccagcaatttcttttgagtcctttcattctaccatggagtcccagggaataccatatacaaaaaaggcgaaattttataatattttaagcattagcgaatattctaatatttacaaaaccttcactttttattcatcagaacctgctattgctgatggtataatggaaaaaataatgaatgaaggggatgattggatgaattggaatgaaacattgagaaacaacgtaacccgcgcccaggaactgaaaacctatatgaggcttaccagccaggaggaagaacacatgacccgaatcctggaacagtttcccatgacagtcacaagatactatctgtctcttattgactggaacaatccggaacaggatcctgtgttcaggatgtctataccctccattcgtgaaaccgacctgtcgggggactttgataccagcggggaggcggataacacagtgctgcccggcttgcagcacaagtacaggcagacggcgctcatcctgtccacccaccggtgcgccatgtattgcaggcattgcttccgcaagcggctggtgggaatctccggcggcgagacagccggaaatgtggaccagatggctgcctacatcctctcccaccctgaaataaccaatgtgctcatatccggcggggattcctttctgaacagcaatcaaatcatacgccggtatctggaggcattcagctccattaaacatctggatctaatccgtttcggcacccgcaccccggtggtgctgcctatgcggatttatgatgacccggaacttctggatattctggcccgctatacaaaaatcaaacaaatttatgtggtgacccagttcaaccattcaaacgaactgactccgcaagcagtaaaagcgatccggtgcctgatggacgccggtgtcattgtaaagaaccagaccgttctgttaaaaggaatcaacgatgacgcagggagtctcggaaccctgctaaagaatctgacaagatacggtgtcattccctattacattttccagtgccgtcccgtatccggggtaaagagtcagttccagattcctttgacagagggctgccgcattgtggaagaggcaaaaaacatgcagaacggccagggcaaatgcatccgctacgccatgtcccacgtcaccggcaaaatcgaaatcctgggccaaatgcccgacaaaaacatgctttttaaatatcatcaggcaaaatatgaaaaagaccagggccgtatattcagcgagaaattggcacctggacaggcgtggctgcaggggtgataacagactttgccgcagactgtttcccggcccatgcaggactttgccgcaggcaaatgttaagccgcgggacataccctaacaggggcatgtcctgcggcctttttgtgccgtaggcggctgtatatgtaattacatcagtgacagatacaggttcttgatatcctcaaaggacggatcctttggattgcccgggcggcaggcatcatccatggcggactgtgacaggaagtccacatcctcaggcttaaggatttcctttaagtcagcagggattcccacgtcagcggacagtttctttaccgcgtccactgctgctttgcggtattcctcctgtgtcatattctcaacaccctccacgcccatggcaatggcaatgtctttaaatttggttcctgtacatggcgcattatattccatgacggttggaaggatgatggcattggcaacgccgtggggggtatcatataaagcgcccaggccatgagccatggagtgcacaatgcccagaccacagttggagaatcccattccggtcagatactggctcaaagccatgccttccctgccctcaggcttgttctccaccgcatccctcaggctgcgggcgattacttcaatggcttttaagttaaacatgtcggtcatctcccaggcaccctttgtggtatagccctcgattgcatgggtcagggcatccataccggtagctgctgtcagtcccttgggcatggaagacatcatctccggatcaaccactgccactaccgggatatcatgggtatccacgcatacgaatttacgctttttctccacatccgtgatcacgtagttaatggtaacctccgccgcggtgcctgctgtggtgggaactgcaataatcggcacacacggattcttggtcggagcaacgccttccagacttctcacatcttcaaattcagggttggtgatgataacgccgattgcctttgaggtatccatggaggaaccgccgccaatggcaatgatatagtcggctccggatgccctaaaagccgcaacgccggtctgcacgttctcgatggtcgggttaggtttgatattggaataaatctcgtaggccagtcctgcatcctccagtacctttgtcaccttgcaggttacattgaacttaatcaggtcagggtcggaacatacaaaagccttcttaaatccccttgcctttgcctcatttgcaatctcctggattgcacctgcgccgtgataggatgtctcgtttaatacgattctgtttgccatgattttcttctcctttacattgacagtacgccgccggacccgtcttaaatgtccgtggatttacctggttgcttttgttaatattataacaagtcctgttttaaaataaaagtgacaaacatccctgtctgtcactttcctttaagttttgtgcagtttcaccatttaggattatgcataatcaccattttctgtctctgctgcggctggggatatccgggactttccggggcttaaagcagtttcaattttccgaacacctctgccagctttgggggcatggcctccaccagcttatccgacatttcccggggcgtatccttcatgcctcctagaacccacttcaccgtcatgtatacagaaccctggcagtacatctccaaaaggaactgaagctcctggcccaaaggctggctggtcttttttgcaatcaggtccgtataaaactggagaatcagttcaaagtcatgttcctttaatgaattcctgtcatcggagcggaacgcttctgtgaaaaacaccttttcattgagaatgaactcaaacttccgggtcaggctctcccccaccgtatgtcccatgccaatctgctcaaaggactgaagcaccagcttatcaaaataccagtttatcagatcgtatttgtccagaaaattccggtaaaaggtctgccgggtcacgccgcagctctccacaatatttttgaccgtaatcttatccacgggcgctgtcttcatgcactccttaacggattcagccagcttgtattttgttttctcctgctttcctgtaacggccatggtattcctcctgcggcaggtactgcacggaaacgctccggtacctgtgtattttgtaacatatccctgcgccacaacaggcagtgcagccctggttgcgctgcactgcccgctgcttctatggacagtatatcaaattttgagacaggcttctacctgtttttgaaaatgcttaccattgccttccacatctgtaccagcacattccacatccgccttaaggggctttccttggcctttgccacctctgcatccgcggtcttggccgtgtcgtcgtccacgctgatctcatcggtgcgcatgacaatctgcagtgtcttgggcggtttgttccggtccgaggtaaaggataccttgtctgcggacggatccataaacaggaaacggttatctgtatcaaacttatccagctcattgtcaatggtatccttcatggtacgtccggcctggcgcatcaccgtggtgctgtccaggatgttcaggcttttatccagaagttccatactgccgcgcaggctgtccctggcagccgcgtcaaaatcatcgctgctgtcttttaacgtgttctggatgatagtcagggtgctgattccattgttgagggcatctgtggtacgccgtaccagttcctgggagtcatccagggcagtctggagatccggataatatacatccagagaatcattgagggcctttaaatcctcaatcagataatccgtattgtcaactatctcggcgctgtatttcgcagaatcagacgtgtcatccatcaggttcgccatcttgtctgtcagggatttgctctgagcagataaatcctgaaggactgccaccttgtcatataaggattgttcaatggctttcgctgcctgtgcggcggcctgctggtccatactgcttaccagagggatgtttttcttctctatggatgcggtggccgccatgcctgccaggcctgtgcttcctgtatttatggcagagctaatagcagtgcctgtatccggggtgttactgccggagttactgccggcgtttccgctgggatctccgctttcagctgcgcttccgctgctgctcccggctgtgcttccgttggtgctttcgcctccggttgtatttccgcttccgctcccggttgtgctcccgtccgtacttgcgcctccggttgtatttccgcttccgctcccgtttgtgcttccgtccgtacttgcgcccccggttgtatttccgcttccgctcccggttgtgcttccgtccgtacttccgcctccggttgtatttccgctcccggttccagttccgcttccgtccgtactaccgcctccggttgtatttccgcttccgctcccggttgtgcttccgtccgtacttccgcctccggttgtatttccgcttccgttcccggttgtgcttccgtccgtacttccgcctccggttgtatttccgcttccggctccagttccgcttccgtccgtgcttgtgcctccgtccgtatttccgctcccgctcccagttccgctggtgcttccgtttccgtctgtgcttccgcttcctccggcacttccatccgggttatccttcccctccgtactgccgctgggatttccgctttcctggtcattcccctgattattattctgggagttttcctggctgctgcctccgccggatgacgaatggctcccgccatttgatgtcccgtaatccacatcctccatgtcttccagttcttcctcatccagctcctcgtcatagagccgtctggccttggtactggaactcttatacagactgagatacgtcagcagtgtgtcctgggatgcctgaagctgggtatccagcgcaatgatggattccatggtcttctggagttccggcaaatcgctgctgataccgcctgcgctgttttctatgttcttaagtctggtctgcagctttctcaaagggtcctgcatatctcccagcgtgttgacaatgtcattcatgctgctgtgaaccacctcggcacagtccttggccgtctgcaaatggggaatcatggtgtccatctgctgtgataccgatgtaagcgctgccagcgtctggtcatttccggccagtatgctgtccttggaattactccacttctgtctggcgctctccgctgagtccataccctggcggacctggtttactccctgccgcatgttctccacagactttgccatctgctccaggctgtcgtaaagctcatcccctgcatcctgccatgtatccttggcttccttcaggtccttgatatgttccagatcctccaccgtacccggtaccatggccatgatcacgccaatggtctcaaagctgtccgtgccgatgcgcaccgtgtaatccccgtcctccccgggaagggcggtaaataccaccgctgtggtttcacccaggttctgggtctgggacccttcagcctccacgctgtagcacttgctcatatccacgggcacagccaccataagcatcatgttgttgcggtaatattccccggcattgtcattgggctctgccttcacattgatctcaataagccccgaagctcctgccagcttatcgccgtccatgggtacaccgttcagcttgtaagatacgtcaaagtcccagggcagtaccatcatgcctttatccacagagcatttataataaaatcttcccctctggtcctccggaagctgccacgtcaccattccgtcccccagcacaggttcgatgctgttagacatgttaatcacattttcataggttccgtaatccgtaaattccgtctggccgttgaggcccaccccctttaccacattaatcttatccaccctgccgtaatagtccaggttcacatacatggtttcatccacgtccacagaaggctgtgctccgtatacaggcgcggtgccagtgccggtgcaaagcatgacaaagaccattcccgctgccatgattctcttatatttcattttcatcgctttccacctccgctggttctaaatcagtccgtttcaatgcggacgccttgttgacaatggtacctatccctgcctttatcagggctttgcgcttttcatggcgccgtttcagatacttctgcaggcggtcccattcattgctggtaataatacggtcaaagagcaccagaagggccggcagcacagtcagcaccagaatcacgctgaacagcgccccccgtccaatcaaatggcccaggtcccctatagccgctgtggtcgatatgaaatgaatgatatatccggccaatatgataatggttcccgaagtaaaaatagagggacaggacagcatcagtgcctgaatacacgcttccttcttctccagggactttctgcaggacacataattgttggtgagcagaatggaataatccaccgtggctcccagctggatgctgctcactatgatgtaccccataaacaccatggtatcccctgccaggtaaggcatggccatattgaggaaaatcgcagcctcaatgggcaccatgacaatcataggtatggcaaaggaccggaagctgaacatgaccaccaggaacacgcccagcatggataacaagttaaccctggaattatccgccgtaatcgtagtcttgatatcctgtgtggaaggtgtttcccccaccagataggaattctccggataataccgctccagaatatcccgtatttcatccgcgcccttaaatgcctggtcgctctctgtcttggtccgtatgtaaataagcatcctgcagtaatcctttgtgtggagctcactggtaacggaatatggcaggaactcctcgggtattccctccggaagggtattggacatggacgtcacacttttcacatagggaagatcctctatctcatctgacatctctttctccgttacagccgaagtattgggatacatggccagcatcatattgcttcttccaaattcccgggagattacctggtcgtccgcatagacctgggttccctcactggctcccaccgcgctgttgccatacaggaaatcattcattccctgggccacataagcgggcggcgccagaatcagcataatgataagggaggcgtagcgcaccctgtagacccattcgctgaatttccggaaggagggcaggaagggacggtgcctggtcttatcattccacctggaaaatttgagaatcatagccggcatgaagaacagcacagttataaggctgaacacaattccctttgccagcaccagtcccatatcaaatccaatggtaaacttcatggataccaatgccaaaaagcccaccaccgtggtcaggctgctggcaaatatggagttgatagcagcgtcaatggcattgatcatggcctgttcttccgagagccccttctgcttttccctggaaaatgcatccagcaggaaaatagagtagtccatggaggtggccagctgcagcaccatagccacattattggtgaggaacgagactgtcccgataaaaatattggtgccccggttcagcaaaatagccacacccataaccagcagaaaaaggaatggttccgaccaggcggtggtactgatgcacagcactgcaaatatcataatgacggcaaccgtaagaatgaggttcatctcgctctccacattttccgtcagggatttgttctgtacagccattcccacataatatcccttatcccctgtaatggctttcatctcgtcaatggcctgggatgtcttctttgccgtatccccctggtcaaaggtgatgtccataacagcacatccgtccttgtagtagtcctcaatatccttctggcgtataaaatcctcgcctgaatagatatttaccgtactgtcgcaccagagaatctggtccaccccgtccactgcttccagtttatccttgtactgcttcgcctcatacaggctcacatccttaatcataagccgggcagtgcccggataaccgaattcatcctccatcaggtccagtccgatacaggatctggccgatgcaggcaggtactccgtcaggtcataatttacatttacaaaaagcatcgctatcagggagaaaacacaccctgccacaaatacgctctcaatccagccctttttatgtataataaaccgggccatacggaaggaaaacttatccccctcctgcggctcccggccttttaccctgtgcattctgtccttgattctgccaaacagcttctgtcccatactcccatgctccttatgctgccgcccattgcggctgtgccctgcaggccttataccctgtaccgcgcaattctgctgcggtatttctgctccagcaatttgcttcaatattcctccgcaaaatccttacgctcaccgcatcagaatcaccacaaaatactgcttcccgtctttttccctgtgggccatccccaggctgcggtaatattccagggaatacttccggtcggtctttgactggaaacgtttatccagcttttcctttattttatcaaatgcctctgacgcgtcctcacagtccctcacgtacagctccagacaggtagcacttcttctgtagttgataacggagaggtaatcgttaatggtaccttctccgggaatcctgtcatctgcatagccccccgccatggctccctccagcctgtggtccgccgccttgttgagggtcatatccatctgaaagcccgcgtaccggtcatagacacggtgcatatcaccgtcatattcatcctcacggtccgggtattcctcaaggaataaatccttcttttcctcattcagctggtcaaacaaatcctgggccatatggtcgtagcatcctgcgtcataggcccctccgcctgtattttccacccagccggccgaaaccagggctccctgtgctgaaaactcgtatttcccgttatccagtatcagctctcccaggttcatgcccccatcttcgtggaagtaataccactccccatccacttcccgccagcctgtaaccatggctccattttcatccatgtaataggaccttccgtctgcctgcagccatcccctgtgtaaagttccatccggttccagccaataccatattccctctgtctggttccagcccggtatatatgaaacgcttatctcctgcgcctgctcatctgccagaactgtcacgggtccggtcccctcaaaggcccacagagctcccgcagcagccagaatgactgcacatattctatatctcatgccatttgccccccgttccttatatatatccattatacaccttttatactgttaaacaacgtccattttgttaattgacttttgtttatttattgactataatggattataataaattatggcaaaaatacaatgattaatttccttcattttgatggttaatcaacattttttccatttttgtgcaaaatacaattgttaaatctttgtaaatacacgcaaacccacataaacaaaaggaggaacagataatgggcattgaacctgtggaccgccgggtgcgtaagacccgcagacagcttcgtgaatgtcttataacattgctcaaggagaaaaaggtccaggatatcacggttcgggagctgaccgacatggcggacttaaaccggggtaccttttatctccactataaggatgtgtttgaccttctggaaaaaacagaagcagagctccaggaagatttcaaccaattggtctgtaaacatgacgccgtggatctaaaacagcgcccttctgtcatattcaatgaaatatattccttagtatatgataacgcggacctgattgagattcttctgggagaaaacggggatttgaattttgtaaaccgtctgaaacagctcatacgtgaaaaatgcctgaaggactggatggaggtattccgctccggcaatgcagctgcctttgacgcattcttctccttcatcgtgtcaggatgcatcggcctggtacagtactggctccagacaggcctcaaggaaacaccggaacaaatggcaaagctgacagaacacatcatcaccaagggaatcggtgtcctggaaattgatccctacgtataatgacacctgaactgtgtccaatccctaaagatagagtcatgtgcgcgcagtggcatgtatatccataaaccggatgaatttttctccatgttatgatatgatgggaaataaaccacaacagaaaacaggagaatacaatggaaacacgaattgaatacagccccaaagcaatggtccgcatccgcaaaggacagggacgttccctgaaagccggaggcgcctggatttacgacaatgagatagagagtgtcaatggagcctttgaaaacggcgatatggtaaccgtggaggactttgacggatatccccttggtaccggcttcatcaataccaaatccaagctgacggtccgcatgatgtcccgcagaaaggatacggtcattgacagcgattttctggaaatgcgggtgcgcagtgcatgggactacagaaaggctgtgacagatacctccagctgccgcgtcatattcggagaagccgactttctgcccggtattgtcatagacaaattttcagatgtgctggtggtggaatccctggccctgggaatcgaccgactgaagccggtcattgtggacaagctcagaaaggtcatggcggaggacgggattaccatccgtggcgtctacgagcgcagcgatgccaaggtccgtctgcaggagggaatggagcgccataagggattcatgggagatgcatttgacaccaaggtggaaatccttgaaaatggagtccggtatatggtggatgtggaggacggccagaaaaccggcttcttcctggaccagaaatacaacaggctggctgtccagaatctctgccgccgcatccagccaaagcaggtgctggactgctttacccacaccgggtcctttgccctcaacgccggtctggcagggtccgcacatgtgctgggagtagacgcctcggagctggcagtaaaccaggccagggaaaacgctgccctcaacggcctgacagaacaggttcagtttgagtgtgccgatgtcttcgaccttcttcccaggctggagcaggaaggccgcaaatacgatgtggttatcctggatccgcctgcatttacaaagtccagaaactccattaaaaacgcagtcaagggctaccgcgaaatcaacctgagaggcatgaagctggtaaaggacggcggctatctggccacctgttcctgctcccatttcatggacccggaactgtttaccaaaaccatacgtgaagcagcgggcaatgtacacaaacggctcaggcaggtggagtacaggacccaggcagcagaccaccccattttatgggcggcggacgagtcttattacttgaaattttatattttccaggtttgtgaggagaaataggtttaaaaataaaaaatccctgaataccggtatgagatgcaatatgcgccattgccggtattttggggattttttcttttattttccatgaacaaaaggcaggaaaaacggataaactataagtagatgatatgataaatagatgcatcattacatgtatatggctgtaagtttataatagcagattcatcgctgcgcaattatagtgcacacttgcagcagtacacttataaatgtacatttatgactgtacatttatagctgtgtatataatagaaaggaccggacatgattatactcattatattcctgatactgactgttctatccatcctggtctgctgttttgtggcaggctcaacgccctatgacagggaggccgacgatgaggcgcagctggaatttctccgcaaatatagggagtccaggaacaggtaaaccagccttagtaccgcgaaattccatacttcttattcctaagccgtctgtcctgcttttttatcttaccaatgatacatttccattaaaatggatactaatttgtctgtgcgggtttttatatcttctatcttccactcatcctttataatcacatcctgatttaagtacagaccgtttttatagcctatattctttgttttgtctttcgatgttctgtctcttttctgcttaaaagacatattataaagatttggattatagccggtaatggtcaggttaccgatggtatgtacgtagcttgcgcggtactgctttgccagcactgcatccccatttgcgatcatctgcacccatggagctggtatattttcaccttcgggaaaaatatgctcaatcgtccacacgtacttcttactggtatcacgagaccaaagatcaacatagatttctctggtctgatgctttgcttcgatgctgcacaagataaatctggcagcttccggattctcgtcgtatatgggaccacgcagtttttcttcaaacaaggaatccggtgcagatacagattgcagctttttacagattttcgtaacaacagcagcgccgcttaacgttttaatcactgtgataatatccatgaacatctgcgtaagctttctggtattcggaacatctgttacgttacggcgaacaaaaaatgtaatcaatgttttgataattccgtttaaatcggattctgaaatttgaagtttctcctgattagacatcaggtacagcagaagaatatacgacggcgcgccggaaattctgctcaagtcttgcagcgcatctgtaaattcatgtatctcatcactgttgtttacgatcacagaatacttttccgctttcgctgacaggtcctccagaaaaaagctgtagtcatattttatcatcttttcgtaaatatcaagaagtgttgttctggttgcaaggtagcccagataataacgcttatccgttttaggatatggctcattcaattcttcccgaaacgcattgtaatactgtctgaaaaatcgctcctgtacagcgtagtcatcctgacctatacaatttagtatatacttccatttttcgtaactattctccgcgtctgaagcatcctctgcctgggcaatcaatgtattcttgatgagatccagcgcggacaaaggaacgcctctgtggttcagcgattcaaaaagcatatatgcatccttatttgtatccacttcaatccccaccagaacagcggtctcaaatctgcgcacaatgccgaacaaagcgcccacctcagttatattaagatttttgctcctgatttctacaatctcatcatcaataagttttccgaaatgtctgtatgcttttgctatacggcgattaccgaaattaagcggtttggatttctgagccgtgataatcccattatcaaacaagataaaagaaaaatcttcgtcattcatattctgtttctgcagaaaaagccgctgcctatattctgttatctttttaccgtttgcggcaaaggtctgctttttgtttgccaattcacttcgcagatttgccagatcatttctatcgtcatcatccatttcatttttgcgttcagacagcttctcatatagcgcagtcagaagaagcataagcgttgagaagcgctgctgcccatcaataacttcaaggacagttccgttaagagaaccgccatttacacaaatgtaagaccctaggaaataaccatgctcattgtctgtaacatcctcaaacaacgcattccagtcgttaattccccaggtatattctctctggtattttggtattctataaattttatcactgttgatggagaaaatgtctgcaaccgtagtctgatctactgtctttatcataagcaaatccctttcacatggtaataaatcatccatccgcacggacaaccgtatcgctgctttcggaccctctgtatcggcaaaacatgatatacgccttccttgctgatattcctgctggtaattattataagtaataaccagtatgatatcaatagaaacttacagcaataggcattacatcaggggcagattttacggctttttgcaaatcctctctgcttaataaaagaaccagaccccacaagaaagtgaaatccggctcttgtcctctattatttttggcacattaagactccctgatacctttaaaccactttcccatttcccagccagccgtatatcttcccgtggattctccggtgaaacatgtcgattaccggacctaatccaaaggtacatacgatggttcctatgccaatctctccgcctaacaacaccgccagaatcacacacaccgcgtccagtgacaccttggcggttcccagccttatccccctttcatggagggccaccaccaggtcatcggtgggattggtgggaaatacgctaatgatataacaggccactgcaaatgccaccaccaccacgcctgctgccatgatgagcagggaggctgccagcccggttccctgtacaggcgccagagcagtcttccacatatctgtaaatatccccagaaaaaaggacgaaatgaatgtctccagtctgggatatccctttctgataaacgcagtcagaatcaccaccagaacggctgtggcataaatgccgagggacgtattgatccggagccgctcagccagagcaaaattcagggcatcatatcccccggcgcccaggtgggcgttgatagtcagtaccacacccataggcataatccccacaccgatgccgtaaagtgccaggttacaggcccatgctccgggcgtcatggacttccatttcctcagagtcatagttcatcctgccttatcacaacatcctccagagtgctgcgggctgcctttcccctgaaattctccagcatcatatcccggcaatcctgtgcaaataaggcatggctgaaatcatttctctcctcccctacaaatttcacctggcaattccggaggactacgtcatcagccctgcgcatataaaatccggaggtcttaatctcctctatcttctgtccatatcccgggcgcagatcatacatgcccttgggccatttgctcttggatctgaccatcacgcgcacattctcaaatagaatgtcttcaatatggtttcccgggcttcctgacagaaatacgccgttttcagagtcgcaggttatgttggaaaaccgcacattagatatgtggccggatttggtgtgttcatccctgtcatgggtggatatggtaatgggttccgcgcatccccaccagcagtccgcaaaccgtcttgtctctatgatgatattggaaaacgaaacgttcctcacatttcccccatcccgaatctggatggatattccacggttgctgtcactgatgatgcagttgtccacaaccacattttcaaaatcccctgtcccctctgttccgatttttaaagcagctgaggtagatgtaagggtgcatcccgaaataataacatttttaagagggccatactccatattgccggaagagctcttcagacagatacagtcatccgcgcatgtaacgtggcagccgataatccgcacattagtggaatgatccgggtcaataccatcagaattagccacattcaaatcatttaaaatccgcaggcctgatatgagcacatcgtcacagccggccggatgcagcgtccagaagggggcattcctcataattacatccctaaacgtgatgtgtctgcaatgctccacatagaccagggttgggcgcggataaaagtcgccagtcacatagtatgggctcacctgcttcacaaaagcataggcatttccgtcgatggcgccttctccggaaatggctatattatccgcatccttcgcatagatgaacacataggaaggcttcagtgtcaccggagttcccacccgatccacaccgtcgtctctttgtccggcgttgggatgaaagtaatgctccaaatcattatgggcctgtaataccgccccgcgttccaggtgcagatccacgttttccttcaagactatagaaccggaataaaaatgttttccgccctccagaatcaccctgccgcctccggcctggctgcaggcgtcaatagcagcctggatggcaggcgcgtcatctgtgatgcggtccgcctttgctccaaaatcaagcacattaaaaatcataatcaaacactcctttcccctgtcctacacagcaccgaccagtgtcggaatcaccatggagaaccagggcacataggccaccagcatcagtgcggcaaagatagccccataaaatggtaaaataggctttatcatatcctccatatcaatacctgccacagagcacccggaaaacagggcagaccccacaggcggggtgatattgccgatacccaggttcatgatcatcatgataccgaaatggatgggatgcatgccaaagcttttcaccaccgggaggaaaataggcgcaaaaatcagtacagccggagtaatatccataaaggtgcccacaaccaggaagataagattaatcatcagaagcaccacgtacggattggaggaaatactgagcatggccttgccaatggcagccggcagtcctgtaaaggacataacaaaggacatggtggaggaagcggcaatgaggaacatgataatagccgttgtctcacaggcatcgcacaatatagctggcaggtcctttatcttaatggtgcgataacacacgatagacaggaacagggtataggccactgccaccgcggctgattccgtggctgtaaatataccggagcatacaccgcctactataatgacaatcagcagaaggctgggcaccgcgtcaataaatgtatgtatgaattccctggccggaacagccttggtggttggatacttatttttcttcgcaatgacaaaggccaccagcatacaggcaacacaccacatgaatccgggtatgtatccgctcattatcattcccaccacggaacaccctgaaagcactgcgtaaataatgaggattcccgaaggaggaatgatgagtccggttggagcagacgcaatattggctgccgctgcgaacttgcggtcatatccttctttttcctccaggggaatcatcacgcctcccacggcaatggatgctgccacggatgagccggatatggagccgaacagggtgctgcccaggatattggtgtgggcaaggccgcctggaataaagcccacgaacagcttggcgaaattaatcagcttttgggcaatccctcctgaattcatcagaacaccgcataaaatgaagaagggaaccgcaatcaatgaaaaactgtccacacccgtaatcattttctggctcgccacaaaggtagccaaatccaggtccataacgcaggccgttgtcaggacagacgaaacaataagacttatagatacgggaacactgagggccagcagcaagaaaaacgtcccgattaaaattaaaccaacttgtatcacagacattgtcatgatatgtcgttcctcccattctcattttttgaagcatccgccgggtgtgctgaggggttttgtttttcgcgggggcatcccgcaacacattgcccccggtatatcctcaattcctttacatcctcccagataaaaataagggcgtagaagataaagaggaccgcacctaccagcagacagctgtagatatagggcatgggaattcccagggccgcagaagactggtccgcagcggtagcgcatagtctgagaccgcccattatcataaccacgatgcagaatacaatgacaaggcactgcacgcctatgtccacgattttctgcacaggcgcactgacctttttcaaaagtatattgatagacaggtgcttcctctttccgtaagcataggctgcgcccaccatggtggtccagaccagaagatagcgaagggcctcctctgtcaccgtacttggattattcaaaacataccgggtgatgacctgccagcatacagccacaaccatgatgcccatgatagcagtacacagtacccggatgatactgtcgattatatttctcatttccttaccccctcctattcagcataactcagaaaatctgccagatatctggcgttatcctcgctctcagcgcagaacgcatcatgttgggactttaccgcctggataaagggcgtcttatcaatttcataaaattggacaccggcttcctttgccccctgtatattgcgttccacaatttcctgccacttctcttcatgtttccaaaagctttcatccatagccttgagcaacgcatcccggtcctgctctgacatggattcccaggtcttagtggaaatgattacgatatccggggtgtactgatgctgggtgtaggtataggattttgccacttccccatgtccgtcatccaccaataccgtctcattattctccgcaccatcaataattccctgctggagggaggtataaacttctccggatgacatgggtgtggccgcgccccccatattacgtatcatttcaatggaggtagggctgtcctgggtcctgattttaagccccttcaaatctgccggactttccaccggtccctctttggtagtataaatggaacgcgctcccgaatcataccagccaatggcaaaaaatccctggtcatatgtggatttgaaaatatcctgtactgcccggctctcctccatcaccttaaaataatgctccgtggactgaaatacataaggcagtgaaaatatggaataggctgggttaaactgttccagagaactggcgctgaccttggcaatatccagtacgccggctttcaccatctgaatcatatcactgttgccgcccagctgaccgttgggatatatggaaaacgaataccccgtattcttttccatctcatccttcatataagtcagccctacatggaccggatgattttcgttgtgggaatgggccaccagcaaatgcgttccgctgccccctttactgcagccggtcaacgagaccagcatggatgttgccaaaagacagcatagaattcctctcctctttttcatgttcctctctcctgttatctgctgaaattaacatagagcctgctctgatgcgcgtctgggacgcgttctggtacggtaccgtatgaagtgtttacatttttcacttctcatgttatagttctattataattgcaaactctttgaatgaaaattgagttatttggtaaaaacattgcaaatcttggaagattgagattaaaaatcgaagggctttgtgcggatgtgccaaattagaaaggcgcattttatgcaatgcgcccaaggataaatggaataagatattaaacagataggcaggagacttatggttacatcatccaaccgtgaaaaaatgctgaagcattatatgcacaccaatgattttgagctggaccaccacagggatattacttaccctgcagtagaaccccattatcatgaattttatgaactgctgtactttataagcggccatgtggattatattataggagatgagatttatcatctgcaaaacgatgaccttctgatcataccgcccaatgtcatgcataatcccatattcgcagatttccgcgtgccatatgagcggtacgtcctgtggatatcgctgccgaccctgcagcagctggcttccattgatgaggacctgaattactttcttaccgcaaaggggatgaaaaactacctgcttcgacgccataccactgcctggggcaacttccgcaccatcttcacctccttagaagaagcccttggagaacagaagcccctaaggcatgcccaggtcaaggccttcattctgcatctgctggtggaatataaccttgccctcatggaagattccggcacggcccagagcggggtacgtgataatccgctgacagatatcctgcactatatacagaaccatctcacggaggatttgtccatggacaccatttcaggtgccttcatcatggataaatacaatctggctcatatgtttaaggataaaatgggaatctcttactatcagtatgtgcttcagcagcgtcttttgactgggaaaaatctgatactggaaggcctccccgccaataaggcatgttttgcctgcggttttaatgactattccagttttttcagggcgtttaaaaaggagtatgaggtgtcgccggcggcgtttcggaggattcatgaggggatgattgggtgatgtgttcttgaatcgttatcaaatcatcattaacgatgcataaacaataatccgctaataatattgaagcccctttttaacatatcatctttaatgagtgctaaaacactaaagtagatcagcataccaatacacgactgtactattatccctacaactcctgatggagttataattccaacacaaaatatgatcacaaacataaacataccaacacacaaataacgaatcgcctctttaagatatgaaaatattggtatatctttacgtacaaaccatatctgaattattgtaacactaagttccgctgtcactgtggcaatacttgcacccagagcgttaaatattggtataagcagtaaattcaatatacaatttacaatagcgcccaagattacagatatagtatatgtcttttgatgtctggttggcagcaggtactgttttccaattacattactaatgccgataataacaatgataggtgatatagccgatatcagtaatataaccggagtatacccttctccataaaaccacggaacaaagttagcagctatcccaataattccaaacataagagggaaaccaaggaaaaagatgaattgaaaagactgtttaatatttttctgtatctcagccgttcttccttcaacaaagagttttgacatctgtggtaacatcacaataccaagagcagttataaaataaacgagaactttaatcatcttagatgattgttcatagtagccaacttgattaatatcagatgctaatattcccagcattgtcttatcaagtactgtataaacttctgtggcaatttgagggataaataaagttattagcggtatcatatgtttaagagtaatgaatttattacgttctacgtgtatcaagtatttaggaagatatgcccataaagaaaggttactaattaaaacaggtaggacataacataaagcatatatattcacatcttgatttgatttgacaaatagaaatacaaaacaaatacttagtgacttgattataatatttctcatgacagcctttttaaaatcttgtattccttgaaaaaaccaggatacatcaaatgcagatgcaaaaacttctaaagctaaaatcagaaacacatgtttgtatctaccagtacgacaaaatgttgccatatatacgattcctacaataaatactgtcaggaatctaaacgtaataatttctttgaatacaattgtacgttttttgatatcatcttgaacgtaagctatttctcgctgcccatacaaattactgcccagagttccaaatagaataaaatattttgctattgaatctgtataaccaaatatcccaatacccgttgctcctagaacgcgtgatatatatggtgttgttattagaggagcaatgactgcaaatatctggtatactgcattgtaaatgtagttttttattaaatgattctttaaacctgttgattcagacataaattacagaactcccttcaaactatttaaaataagcactgcctatagatatgtatctctatttaaaaatcagtgcagcctgaatctttgacgaaaacaaagctcattattatccattgtaaaacggaagtcaatacaacatttgtacacaaaaaaatccaaataaaggtcaaaacaaaagctacatttttccatttttttcttttaacagcgctgattaaataggatgtacagggaacaaaaaaaatcaacaaggcacttaagcctcccattgcaataaaatatgggaggccaactgataacccctgctgataacgtaattgttcaataattaaatccctgttaccaaaacctacaccccagggaaaactctttataaataaatttaagcagccaacaagatgatctgttctgacattgtatgaacctgtggtggttttatccataattataaacgaaattatacccatcattatagcaaaagcaaatggaagcaagagcggtttcaccgaatttaatagtctgttgctattttttctcataattaaatccagcccttcaaatagaaggacagctattatagcagttgttgaaaatgttgttatgattgatatgaataaaactgttgaaataaacctgttttcaacaagataacatctttgaataatataggctgtgcttaataaaaaggcatacatcggtgcttccgtaaaaaaggcacaatttcgtatacctctaaaaaatagaaaattaatagtctgaggttcataatataaattgtgatacgaagtggctattcttatccaatcccattcaaatgtaacacttcctgttggagtaataattttcaagacactaccaaaaaaccaaaaaaataaagataaacatgcaatccctaccataatccttatatatttattccagaattcaatcgttgcattccgggttaaaacaccacttaaaataagaaaaaccataagcggtacataaaaccatataaaagcataaaagaaggtattccaacaaccaatcatataaacagacatgcatactgtataaaagacactataatgaatgaacttcctgcctaatttaggggcagataaaacggactttaaatatataattaatatcccaattaacaacaagcataatttaatgtatgtaaaaacagaccacaagagaccatatctgaaccagattgccccagttgtagtaatcactagaaaaatcaaaatgtactctaatgcatcaacaaggctgaattttgctttagtattgtacactaatctcggaaatatcatttgttatggactctccctttttatttataatcccatccatgctctaatcattctcctcactttaaaagtaaaccatatacctattggccaatttaatctggcagtccagcaggttaatttttgttgtttcatcaatttaccagactctacatttttaattgcagtatagtatggttctttatgaatcatagctttcaactctctcaagttctcacttaacatttttccattgttcctggaaaaataatacacaccaagttccgcactaagtcttctgacaatatacatataaaacggtttttcaaagacttctttgttatcctgtgcattaataaaatcttcaatgcgttcaaagattctgcgactaatatctaacgtatctgccttataagactgtgtcaacgatccatgtacaatcctataattataaactggcgcagaaacatatgcgaccttcctaactctattcaaatagtaaagtgtgaaaaggttatcatcatatatacctctcacataagagtcatagcgtaatccattctcaacaataatctttttgctatatagtttattccaagggcttcccagtcctgtgacatttcctttatccgctggaagcggattatatccgtatccaatacaggctgcctgatactgttttataaagtcaacatcctccgtcacaaattcttctttaaaaactctcttccggtgttttgccccatttataactgtataagcatcagcaaccactaaatcagccccgcttttttcatatgccttatacaatatctcgcatccatctttctccatccagtcatcagagtcaataaacatcaaacattcaccagttgcatgttcaataccggtgttccgtgcctcagccactccttcgtttctttttttaattattttaatccgactatccatctccgtgtatttttgatatatttctgcgctgttatcctgagtcccatcatcaataacaataacttcaatatccctgaaagtttgcttgataatgctatctaaacattgtgctatatatttttcaacattatatacaggcacaataatgctaatcttaggcattgctcttctccttatctttctttttttctccggttttgtatcttacgtaatccattacacttgagtgaaacgaatattgaggcaaccaatctaactctctataaattctctcacaattcatgcctgaattaagttgtatttctgaaggacttaaaataatttccgcactgtctaaacctaaactttccaggcagtagtttacctcttgtgcaatatccattatatttatctgataattatttccaaggttgtattctcttttccacatcatattctctttttgtactaatctgcagacagcatctgcagcatcttttatatctaagaaagaaaatttctgcttccctccaattatgtggattgttttattatatatagcatcctcaataaatttacttattatatcatctgggattatgttgttgactccaatcaaagatgccagtcgtatattggtatatagactattatcaaccgcccctatatttgcttccattattccttctattaaaacttcgttagctgcttttgctaacgaataaagatatcttggattcacagacatagtttcatcaggtaaattctcattagcctgtccatatacagattgcgaagataaattaataattctttttacgccattcttcatcgctttcaaaaacagaacttttgaaaacttcagactctccacaagattctgtccatcagactttctgcaaaaagctgtatgaatcaggatatctgtataatttaaatatttcggattactgaatacttctttatttgatacacaaattatatttaatcccgcatatttatctactgtagttttctggtccgatgtcatagctatgatatgataatctgttttttcttttaattcatggattaacgtccatgcaaaatatccacctgcacctgttatcattactgtttttttatcactcatgcccatttcctcttaatgtgcctagataaatgcgttaacaaaatcggtttcttcaattcctggcaaaatcatgttttcacctttgtccgattcaatatgtatcaacttttggatttccagcatagttttctgcattgtttcaacactatcagaaactcccaatacgcgaagcgatatctgcgccaatagtcctttcatggtatctgtaatctcttctcccggataatgggccaaaaccgcatctattacctgcggcaatttaagaatatcttctatcccggaaattttcccaattctgcctggcttggttaaaacagatacattgaacgcgtattttccgagtctcggatttatcctatccgcaatactatccttttccatatgaccagtcaatgcaaacctaatcatcatctccataggatcatatccgcatacctcttttaataacttatactccaaagatcccgtcagacgataacctatatcataaactacgcatttcccattttccaccttacactgcataaacatcattccattttgaatccccacagaacccagcatattcttaacatttttctcaatctcggaacaatatttctgtgtcacagcggcagggaatgtatagcctacaggaagcggaattactccatcctgattttgtttaacatgcctgtttccaattgcagtcaaataatattttccatctataaacagccaaaaaacagtaacctctttcccctccacatatctttccaccaaaacttggccagaatgagaaaatacttcagccttttttaatgccgccattagtgtttccttagattgacatacagttattcctttcgccccgctgctatcggttggctttaccaataccggaaaacttaactcatcatctaattttccattcaaaatttgattaatactatattcttcaactgtagggacattatatttacggcataattttttatatatgcctttattcgtaaaaatatcaaactgctccttcgttccataggatggtaatcccgatttcttgcagatttctgcataataaggcaacatataatcattgaagccaaccatcacaccattaatttcttgttcttttataagtttcacaatctcatccacatctatggtacttaccagaaaatgttcatccgcaattttcttacctggtgaatcctcaattttattatagtctgcaacaatcgtgtatatccccatcgacttggctttatgtataatttcacatgaaattctcattcccccaaggataagcagcttcatgccttgaaactcattatccattacaacactcctcccctattccatactaccttgcagataagctcaaccatatactccatgtcctctatcctatatcgttgatcaacaggtaacggtaagatactatttgccagttgatactcatacgattcctcattcacttcatttattacatttggccataatacaggaatgtatactttattccgtattaaatgacaccttacctcttgtgcttctttcagcataagaggataggcaaacgcgccttccactttctgaatatttaaaaggttataatcatgaaaacgtgaagcaagatatgtataattttctgtcctaatcattctcacctgatcataatcaatgcttcggagcaaattctgtgtcaatttcgacatatacttaattggctgagaagtaaaaatttggttattcgcaacatactcattataaaattcagaggcagaacgctcataacgacctaataagaaatgcattcgttcaaatgactcatccctttcaatcggttctggtaaattgctatcggtatacaaaaaggccccgtcagggactccaaaaaacttgcggcatgtgtatatggaatcaaccccatctattggcttgtcaaagtatgcttgagcataatcaacaattatatgctcatagcgcagcgaaagccctttaacttgcatcgaatcaatctgcccataataattgacaacatataaccactcatctttcttgagaaccaggtcctctggcatcaaattgtccttcaaactataatagcgtatattaacattatattttttacagatattttttacagattcacatagaaaatatggaagtgcaatactggtaatacctctcatcttaattagataggccaggcagtttcttccgcaatttaattttattgcactttcgtgcaacatctccttatggaattgctcgaattcaatatagccaccaatttctctcatctgtctgtcactccaatttaaattattatgtgattgagcgaatcagattatgactctctgcagttcggtattttcctcgtcaaggcaccaatccggatacactaagctttctttactatttacgttgtcataaacatccgcatattcctgtggtacatcttccatatttatagctctgccatccatgctatagcccataaaggttccccgaattgaaacacttgcacgggcatctgcgcatttcttattaaatgcaaattgaaataatctaattacctgccggcaatccgtaagaaagctaacatgttctacataccatatgtcattttcaaattgctcttgccacgtccatacgtggtccgttaattctctaggcggacactctaaacctggccgtacagaaaggcgctgtttatgccgtatattatatctttccagatattcaggaactaaaggtcttggaccgatgaaactcatgtcgccttttagaatattccaaaaattcatcaactcatccaatgatgtttttctgacgaaatgaccaaacttcgtcactcggtacataggaggcaataactccccctgttcgtcaactgtgttacgcatatttctaaatttaatgatgctaaatatcttaccattctttcctactcgttcctgtttaaaaaaaatcggtgaaccaacatcaaaatatgtacctataccaattaacaaattaattggtaatgtaatgactaacgcaattatagatatcacaatatccagtaaccttttcacatatcgcgtataaataccatctcttggcactacctttttacataacatattgacttggtttaatctctcttcagccagacgttctgctatttcccatcgcatctgctttgttaactttgacttttccatgtctttgtccctctcatattaaacaaggaatcataaacttatcacctaaactatttcaacttttattttcgccttacttttatccatttgttgctgttatccatcatctcaagcatctgattcatactctcaaatttcattattaaacatcccaacgtatcaccggctcctgtaaatgcgttcatctcatctcctttcttcttttttatatagttatctacaatattattttgtctaacactatcccctaaaaccaccttatccaaaatccctccataattactgtgaacagcatagtatgaccaaaatcctttttgaatgcctgatgttatataactcaggtcctcacccattgctgccttaatagcacattctaccaaatccacccctgtggcatattgtataacctgaggtatatagttccctccatttcttggggcaacttccataagatatacattgtaatctttgtcaatgcgtaaatcaaaattataagtgcatgttttcatccccagtaatgtcagtaacctttgtatctccaaatgaatcttttcctgaactatatctggcatattgtaaggaaagctggccgctacaggcacaaaggggtttggagcatgtatatcaaaatggtcgttaccaaaacaccggaataccaaacgtccatttacagataaaccatctcccgctatctgataaccatacttttcaacaaattcttcaacaataatacattttcttcttgaatagtccattgcgttttctaatttttggacaatggcattttggctttcccccttcttaatacggctcacgcccttacttcctgatgagtcaactggctttacaataacagaactctgaaaaatatctccattaatgtcatcgaatgcagcttctaccgccccatagcttcgagcttttggtgtgaaaaatccatgaattgtaaggaattcacgaaacttatctttattacaaagaatttctacggacttatatggattcccaggtaaacctaaattttctgacacatatgcagatgtaagcgcagcaggttccgaagcataggctactacaccatctaccctttcctcttttgcaatgttcaatattgtttctttatcagttgtacttcttaaatagaatttatcagcgagatatcttccgggattatctgtcaagtaatcacaaagaactgtataataccccaatctctttgccgcctcaatagctataatttgttgtgccgatccacctaaaagtaaaatttttttcattattaatgcactccatcaccttataataatgtcgcatatataatcaacatcctgtagggttaattctgcatacataggcaatgttaacacgcattcagaagcatgagcagccaccggtacatccgcagttccataatcttcattatagcaacccgctttatttacaataggatagaagtattttctggcaaatatattttctttctctaattttaatctaatttcatcccgcgtttctttatacccgtcaaaaaaaacaggaaaatatgaataattccatttcaaatttgaattgggaattataagccttaacccctttattccagacagacgttccacatatctatcccataccatcttacgttttgctatttctccatcaatatattcaagattacaaatacccatcacagcttcaaattcattcattcttgcattcgttcctacatattcaatatcatcttgacttgtaaatccaaaattcaccaaatgtcttaattccttaaaaagttctcgatctttataagcaacaataccaccttcaatagtatgaaatacttttgttgcatgtgtactgaacatggatgcatctccaaaattagcagatccgatacctttatatgtaacaccaaatgcatgagctgcatcatatatcactttcagtccatatttatgcccaatcttctcgattgcttctacatcacatataaaaccatacacatgtgtggcaacaattgcagccgtattttctgtaatggcggcctctatatattcgggatttatcgtacaatcagattctctaatatccacaaagacaggtttcaatccattacgtactatggcatgaattgtagaacaatgtgtaaatggtgtagttatcacttcgcctttcatatgcaaagcatttaaagctacttctaaagccagatgaccgttagcaaatagatataaattgtctgtctcaagatactgtttcaatttttcttcaaattcgacagaagcactccccctattggataaccatcgactatcccacaccgtttttagcttttccatatactcatcaaatcccggcattgatgaccgtgttacgttaattctttcgtgtaccattttttcctccaaataataataagtttttctatgcttacatagagcagtactattcatctctatacaaccctgtgtaaatccagaatattttcaccacctaccattcttaatgcagaccgggggcccggcctacgccatctaacccccggccagcacttctcaatactgctactacttatacactaccgataacgtccccgagcccggaacattcacagccactgtcttagtcaccggatccaccttaacagccggaatcagctgccactggcctgtggcattgtcatagaacaataactgtacgttattgacattcgcaaccaggttgggcacatacagggaaacctctacgggacctgtcttaacagtgcctgtattagcatcctttgtgatgattgcatgggttcctgtcagggcataaaagcctgtcaagtccacaccctgaacaacctcgtttaacggttttcccgcattgatatcattaatagccgataccacatccgatggaagtcctgcagttgctgctgtgctgtctgcaaatgcaacagcggtgtcaccgataacagcctctcccttggaattggttgttacctgctgccctgtggttgttacagtgtccaccgcaacgccaatcgtgctgccggtctggctggcactggttgtggcgcctgttgtcttgacacctgtagctgacacagttaccgtggtgttggaatttgtgcttgtagtgcctttgttgctgctggacgaacctatggaaccgctgccatcactgctgctggatgaaccaatggagccattgctggtaggactgttggctgcaaatgcccatacaggctgtgatgccagagcaaccgtcagcactaatgctgctatgcatttctttttcatatccttcacctctcctttctctcctaagagtagttatattcaataaacagcatggtctcatgctggatattgcatgtttgcacacattcaccgccaaataccgttcttcttccttccaacggcaaatactgtggtccttcatccctgtctattcaatttcccggtagaacaactccagtaaaatagggatcagtgcttccctgtccgcataaaattcgtcaaagcggagtgtcaccacaccttccccgggtactgtataaaaatcctcgtctcccagttttccgcctgcgacagcgtccatagcaactttaagatactggtccttggtcatgttagtgaccatgtaatcctgaatcctctcaaacagcctgaccacaagtccgctgtccttggccgaatgcctctggaccgcctggaaaaacccctttatatattgttgctgctggtccatacgatacaaagccgaatggtccacattcacatcccggtaacggacaaatacttctgcctgtttccctttcaacgtcactgtttcaccctttaccagagcagggtcccgattctccattccatctgtctcaatcgttaccgtaactccccctacttcatcattcagcacagggataacacttgtatcggctgccagataccactctatcttcaggccccccaatagttctgatactgcatccgccatatattgacagctcttctctctcccatcaccgtaggcgtaagccagcgtcaggtgctgcatgtccttccccagttcattcccgctcaaatcagtaagcgtgatatctgtcatcgtgtcacgcggtatcatcaatatctttatggtattcctggccgtatcctgggcaatcagaaataccccgtccgcctgcccgccaaaaccggtggtggttttctctgtcatttctcccgaccggtccactccaatacacaggatggccttcacataactgctgcgcctgtaccgttttccactatattcaaccacatctccgccaaagaggtatgtgtcccactgcccgcagtcctggctgcttccctggctgtccccttggctgcctccctggttgttcccctggctgttcccttggcttcctccccgtcccacataatccctggccgcaatctcagcttcgaggagtttcctattgcggtacagattcaccccggcccatatgaagcagagcagcgaaattgccgctgcccccacagccgcccggtatactgtgtgtttgtggttacgaagccagctcatgcctctgccttctcatatctgccatacttgccgtaatggccatatttggaatactttccgtatttgccgtaacgtccataatacctgctgtaataaccgtttcgctccatgctcaccttattgagtacaaccccgaggatacggcatccgcttttttccagctgtcccttgacccgctgctccagacggtagcttatggagccgctctccaccaccatcacagccccgtcgcactgacgggccacgattgctccgtctatcagattagccatgggaggtgtgtcaataataacgtaatcgtacaattgccttaatttacaaatcatatctccaaacaggctttcctctaaaagctctgccggatttggcgaatacggtcctgcgaatatgatactgagattttctatattcgtgtcataaaggacatgctccattgacctctgtccgcttaggtattgggacagccccgccacctcccgttccagctgataacgggaaaccagtacggattttcgtatatcggcgtcaatcatcactactttcttaccgatttgagctagagacgacgccatggcaaatgttatgtcgctttttccctcgtcaggcagggaactggtcagcatgattgtcttgatgccgcttccgcagaactgtatattggtcctcaatgttttgatggcttcattgtaatggtagtcatccttcatctccctgtttagtgcaacaaattgtctcatgacgcctggcctccccttttcttttttctggatttccctgttgccgtcttattccttgattttgaggatatcatggcctccttatcctctggcttttctccttcacgctccggcaccgatgccaggacagataatccaaggtattttgcaacatcctcctctgtccggatggtatcattcataaccacattcacggtgatggctccgcagaccagtacggctcccagcagactgcctatcagtgcattcttcacattgcttggacttgacctgagtatgggaatttccccctcctcaatcagtttagggggcaccatctccatgatatccccgatatagtcggaggatgtggttgcaatcttgtccgcgattaattttgccatggccggatccggatcctccacggaaatagagagaatccgtgtgtcctggggattgtcaattgtcaccttctctactaaatctttatatgtaaggtccagctccatctcctcaatgacctggttcaggactctcctgcttgtgacgataattttatagtccttggtcagctggcttcctatctgcaggtcggccagcgatgtcaatgtggtttcttttgagaggatataaaccattgcagtggacttatactggggagtgagcacaaaggcgctgaatgctcctgccacacctccaaacaatataataactcccaatatcatccatatcctgcgccggaactcacccagcaattccaagaggtctatctcaatctcgttgtcatcatacgtcttttccatacctcgtcctgttctcctgttttttaattgtatttcgtttctgtattttcgtttctgtattttcgtttctgtattattttcttcgcatttccccgcagcaggctgtggagtctgcgcccatccagatgtttcacaagccagcaaaagctctcctctatgtccggttttctgtagtccatgcggtgcatatcagttcccagacaaaaaattctgccctccgtaacctgcttcctgcaccagcgggtttccttatcccataaatggttcccactgaggctgctgtaattcatctgcagcctgcagtcacatcgggctatctctgacaggttggtcccttgcctaaggcacgtataccgttctacatgggctatgaccggtatgtatctggccatggtcagtttcctgattgcctggtacatcttttcataggatacctggggatcaaattccaccagcacatattggctgccctccagggtaagggcctttccctccctgagatggtccaccaagccctcatgataataggtctcctgccccagacctgtcataaaatccggtgcaatgttgtgtgcctcctccttcaaacgttctgccagctcatatataccggaaggcaaaccactcctggaataatggggcgttgccacaatatatcggattccctgcctgtaagattcctccagcatccttctgctctcatcccagtccctggacccatcgtcaattcccgggagaatatgtgcatgcatatcaatgattcccgtcatatcatcaccccgttatattttctatacaggtttttcaaataaggaagcatgtcctcggcccagaaatattcaggcatataacttccggaaaacagggatataaactccggatttcccttgataaattcatagaaatcgcagacaaactgctctgtatccaccgcgtagctgcctcgtttctttattaatatttgttctattccatattccatcaggctcatccgaaggcggtaaaatacaacccttaaattgtttttcgccgtgctctctttaatgttttcatataacagatatgtcatctgggataatgaaacgctgcttccgcgtttttcgaccataattgcaagcatctctttcgctttgctgctgggaaaataaaccattttaccgtttacataaacatcaaatccatcaaaggtctttataaatatagttacattccccgtttctgccatcagcgttatttctcccgttattccaagtcgcataccactgttctttgtaaggatataccactcaattgctttcaaaatcgttacaaaaccgtttcactttgtaataaaatggtatttttgtcgatttatggatattctttcatgtagtttgacaatttataatttataaaactaacattggttccatggacagcgaaccaatgttatggttcaaaaaaaccacataataaaaattatgtggtccatatcctttccccgttacccatacccttacatttataaagtgatgaagttccttgtgttgaattatcatatcattattaccaaattccgccaatcccaggggggatgcaatccttaaagaaacgattcagccgttctattaggtgagatcaaatgataataaaagcgaaaaaaggcatccctctgcggaatgcctttttactgaactgccggctgcaacgccatcattctatccacttttataaaagtccgtccctacgactccccctcctcaaaataatcccttatcaaattcgacaaagtaacctccgcccagctatactccggcatatactccccgacgaaaaagttagaggccccctgaacctggcggaccatatcgtagctgtcgcagaccacagcctccttattaatggcataggttcctctgcccttcaccacaatcttctcaatcccatatttcttcaatgtctgcttcagtctgtgccacgctaaatggacagcctgtttggctgcggtttcgtcccgttctccttcatttaaaatctcagccaggtgagataatgttacttcctttccgctccagtccacaagtattgcgagaagttctttggctttgctgctggaaaagtatatcagctcaccttgataatacaaatcaaaaccaccaaaggtttttacatataccttatccgatgttatatcaaacatgattcatgctcacctatcatcccgtattcaaagagaatctgcttctctttgtgtgcttctctttgtgtgcttctctttgtgtgctcctatttgtatcctcctcagccatcaggtcctatttatatgttaacataaatgtcattgtaagaccagttttatatccatgaaaatacaaataatgcccctccatattttacctaaaatatgtattttttcaactggtttattaaatttgtgattttaatctgcctccacaatgtttgcaaccacctgtgttaaaaataagtggtaaaaaagaaaggctccgcttccattccgcggcgcccttctttttcactatggtccttcgtttcttatcctaaaatcctgtatacccaggtgtcagccgcagcttcctcagggctgccgcctttaccgcacctgcatacctcttttattttcccaccaccttgtacgtttcctccacaatacgctccatggcgttgagaatgttttcatatcccgtgcatctgcacaggtggccggatatcagcttgcgcagctcatcgcggttataccgctttccggtacctacgatctccaccgctgtcatgatcagtcccggcgtacagaaaccacactgaactgctgcttcttctataaatgccttctggatagtgctcagctcgccgtttggcccttttaacccttccactgtcatgatgctgcggccttccgcccacatggtcaggtagatgcagctgtctatggcctctccgtccaccagcactgtgcaggcgccgcactcccctacttcacagccctttttcacactggtcagtcccaggcggttccgcaatgtctccagaagggattctcttgggtccactgccaactccacttcttttccattaacagtcatatgcactatgttaagcatcccactcacctcctgcattgattacggcctgctttacggcacgcctgcccagctcctccaccagctgcagcctgaactccctggaagctctccagctggaacgcggattcacttcctccagagcgccttttcccacagcctgggccagggcctcccctgtttccattccctttacagcctcttccgtcgtatggcagcggatcggagtgggcgcagccaccccgtatgccaggcgaaggtcctgtatgtgtttcttatcctctgtcagcttcacgcttacagcacaccccagggtggcgatctccatggcatttctcttgccgtatttgatatattgaccgccgtagccctggtagttctctttctttatccggatagccgtcagcacttcatcgtgattcctcacagtccttcccggcccggtgtaccactggctgatgggcacctccctgacgccgtcaggccccttaaggaccaggaccgcatccaggcagcacaggctgctggcgctgtccgcgctggtcacaccgttgcacacattgccgcctatggttccgatgttgcgcagctggggaccgcctgccatgtccaccgcatctcccagcatgggaatatgcttctgaatgatgtcattattggtaatatgggaaaatgtggtggccggacctatgacaatggttccgtcctcctccattcttatgccctccagctccttaatcccgtgaatgctaaccagggagcagccggccagctttccctccctgattttaatcagcacatcgctgcctccggagatgaccactgcctcagggtcttccactagggcgcgcaccgcatcttccacatctgctgcctgataaaattttccgatatcatacatgctgtttcaccgccctttctatattaatcccgcttccttgaaatgcttcaccatcttctgtggatccatgggcagactgtccactgcaacgcctgtggcgttaagaactgcgttgcgcacagccggggcaaccggaatcgccggcggctccccaagcgccttatttccaaagggacctgtgggatcatccaactccacaaagagtgcgtttaagtccggagtatccatggctgtgggcagcttataatccagcaaattgtcgtttaacggtctcccctttgcgtcaaagagcagctcctcgctgagtccgtagcccagtcccatgctcatgccgccgtgtacctgggcagcagccagcttggggttaatcagttttccgctgtcatgtacattgacgatattggtcaccttcaccttgcccaaaggcatatccacctccacctccgcaaagcaggcacccgtggcaaatgtattggtcttgcaatggctggtggcctctgccgtgatatgtacggagcggtccaggctgtaaaatgccgtggtggccagctcctccatgggcagcagctgcgttccggtctccttatccacaatgtggttatccctcacatccagggtatcctggggcttctccagcatataagcagcgtaatccagtatcttttccttaaatatagcgccggttttcttcactgccataccgctgacataggtctgcctggaagcatatgcgccggtatcaaaggggcttacgtccgtatcctgggtggacagcacatttaccttatcttccgtgattccggtcacctctgccgccatctgggtaaacacggtgtcggcgccctggccgatttccgttgcccccatctgcagctgcatggagccgtcctggttcagtatcatgcggcaggatgctgtttccagggatatgggatatacgcctgtcttatagcagaagatagccataccgattccctttcgcacgggtcctgtctggttttcatattccctgcgtttctcatcccagcggatgaattcccggcccttttccatacattccgccaggccgtatgtattgcatttcacatgagtgtgggggtcaacgtatcccggcctcatgcagttctttttcctgaattccaacgggtccatgtgaagggccagggccaggtcgtctgccatgcattccgcggcaaacgctgcctggggaattccgtatcccctcatggcgccgcccgtggccagattggtgtacacagtccaggcatcggactccagcaccttctcatccttgtaaatctgcttgaactcattggaggagttggctacgatggcatgggcatgggacgcgtatccgccctggttggaatatgcctccagcttcctggcaaccagcgtgccgtccttcctggccgctgcctttaccttgaactcgatggcatggcgcaccctggtacatcccagagtttcttccctggatatctccatccttacccctcttcctcccacctgggtggtaaggaacgcatttaagggctcatagagtacatcctgcttgttgccgaatccgccgccgatgtagggctttatcacacggattcggcccatgggcagtcccagcgcctggctgatgacacggcgcacaatatgggggatctgcgtggatgtggtgacgatgattcttcccttttccatataggcaaaggagatgggcgtttctatgtggcagtgctgcacgctctgggtccggtagtccttttctatctccaccagtccctcctccttcactgcttccccgtaagtcccttcgcccaccacaaaagaagaatgggcgataacatttcccggtttttcatcgtgaagtcgggatgcgccctctgccatggcgtcctccacggtcagcaggggagcatactcctcatactccaccttcacaagcctggctgccctggctgccgctatatcgtcctccgctatcacggctgcaatatcgtctccatagacccgcaccctggtattgagaagtttcctgtccgcaatatcctgatgggccgtttccacggaccatggatggccgggtgtggggaactggatgtccggcacatcgaagcacgtaacaatcttcactacccccggcaccttccgtgcttcttccaaatcaaagctttttaccacgccgttggcgatggtgctgcgtattacctttgccaccagaagaccctgtggctctaaatcggctgtatacctggcactgcctgtgactttgtcaaatgcgtcaacgcgggtcatgtttttaccaattcccatggtgtgctctacctccttatcctgaatgcgcaaacgcctgtattccaggcgtctgcattatatgctgctcgttttaaattaatacatacttaagtacaaataatatagccaatatatacatcagaaggctgattttcttctccttcgcatggccggttgcaacgttgataaccacgtaggagataacgcccattgcaataccttcggaaatgctgtacataaaaggcatggcgatgatggcgatgtagcttggaattgcctctgtaaagtcgttgaaatcaatcttcaaaattgagctgatcatcaggaaacctacgataatcagggccggtgccgttgcaaaggacgggatggctaagaaaatcggtgacaggaacagggacagaccaaagaatatagctgccactacggatgtaagtccggttcttccgccttccgcaacgccggaagcgctctcaacgaatgtggttgtggtggaggtaccgaatacagcgccaagggaggtaccgatggcatcagacagaagggcgcctctaatcttaggaagctttccgtccttatccagcatatcggccttggatgccacgccaatcagtgttcccagtgtatcgaacatatccacaaacaggaacgcgaacatgatggttacaaagttcagggacaggatgccgctgaaatccatcttaaagaaggtgggcgccatgctctggataccgaaaccgctggagaaatcaggaagtacgctgaacattcccagctctgcatttggctggtacagccctgtcacttcgcagataatacctaaaatccatgtgatgagaataccccagaggatgtttccctttatgttcttaacaaccaggataccggtaataagtacgccgataagggccagcagcacggtgattcccacggaattaaatgttcctgcgtccagagagcctttgaatgaaaatacggatacaagggtggcgctctccaccacgattttagcgttctgcagaccgatgaaggcgataaaaagcccgatacctgcggatactgcgtgtttcagattcatgggaatggcattgaaaatagcttcacgcacattggtaagagacagtgcgataaagataaggccttccacaaatacggctgccagagccatctgccaggtataacccatctggagtactacggtgtatgcaaagtaagcattcagtcccatgccgggcgccagcacaaaaggataattggcaaatgcagccatcagcagggtggcaaccagggatgcaagggcagtggctgtaaagacagcacctctgtccattcccgtggcgctcaggatgttcggattcactgcaaggatgtaggccattgtcatgaacgtggtgataccggcaattacctctgttttgacatctgtgtggttttccgacaggtgaaatactttttccaggaatccctgatttgatttgttctccatacttcatacctccttgaattcatacctatagttttccgctgtttctattttaaagaacggtacccctttccgcccttttatgtatctattcaattttcatttaaaacatcttctgttaaaatatctttctgcccgccacatacttggcgtcaatatggcgctcatccgaaaggtaaatgaaccgctccagccgctcctttaagctcagaggctgaggatgcttaaggctctcgtcgttcagcaccagcgcgtctaactcatatccttcctcaaagcttccggcctttccgaagaatccgccgccgccctttgttcccaggtagaatgcctcctctgccgtaaggggcttgcatgtctcatccaccagtctccagcgcagcttcgacacctggatggcgtcagccatggctctgaacacggactctcccgctcctccggccacatccgtgccaagtcctgtggggataccctgttccagataggtcctgacgggcgcaatgccggaggacaggttggtgttggactggggacaatgggccacgtatacgccgttgtccctcattctctgtatttcctcttccggcggccacacacagtgggccatgatggttttcacgccgctgccgaacatgccgaaatggtcgtatgcatcgccgtaaaactcagaccacgggcaaagttccttcacccagtcaatctctcccttgttttccgacaaatgggactggaccggaagatcatactccatctgaatcttcttgagctcttccatcagggtgtcggagcaggtgggaatgaaccttggcgtgagaatgggagccgtgttcctgtaccgtccctttatgtcctccagccattgtctggtctccctcagggattccgctgtctcctccaccaggatatccgggctgttccggtccatgttgaccttgcctaccatggtcttaagtccggtctcctccatcaaatccatgagaagctccgtagcctccctgtgcatggttgcaaatatacaagcccttgtggttgcactgtgtttcatgttttccgcaaatatggtatacgccttcccggcatactccatatcgctgtacttggcctcctctggaaacgtccgcgtgttcagccattccaatagttcaaggtccatacccagacctctgaatgaatactgcggggcatggagatgaaggtccgtaagacccggcacaatcagcctgtctccataatccgtcagaggaaagcctgcatacatctgcggaagttctttgtacacgccggctgattcgccgtctgcacataccagatagccctgttccacacaaatcagtgtgcgggaatcctggctgtagcagatattgccctttaatacaaaattttctgccatatgctcctccttttccgtgatacgccggtgaccggcgcacccttgtattcacccgtacagcggcgggcccgggcttctatctgcatttttttgcaaacaaaaaaaccaccgctgttcctaaggctccacatcagcctgtctccggcgccccgggcagtacctgatgtgaaaacttatagtcaactattacggtagttggtagaaacgctcaacctatcttgagcatatataagttttgaatacttatacttctattctattgcgtcatcttctgacatcttgagtctatcacaatagacaactcaatgtcaatatatcttgtgttttttgtgcattttctacattttgtataaaataattggcagatatatgaaattcctcctttttctttgtgcgaaaccaatattcttctaaaaatataacgatatgattaatatagatccgccagctggaggagctgtcccaaacgtgtccggaacgccggacggtttacggctggcatacgccgttttacggtgtgattttgtttattccggttaacagaaacagtataacagcagaagaaacaggtcggttatgaacctatgcaaaaaaccagaaggaactctccatcaagaaaatttcctcctggtttttttacatttttaaagagaaagagctgtttggtcatctgtttaaatgactttcgcccacgcatcccatcctctgtcaccgcgccaaatcgtctgccaagcgcttgatcttctcccgctccccaatcacaatcaccgtatcctcgtcctggaacacataatccgggcttacatctgtggtcagccatccgcctctggtgatagcgattatgttgatgccgtaccggttcctcagctgtgcatcccgcacagactggcccgtaagcttcctggtggtctttatttcagatatatccacgttctggtccagctcaaagagattgaatatgcgcttggagataagccttctggccaggcggactgccatgtccctttcaggatataccacctgggctccgattttctccagaatctcgccctgttccgggctgttggccttggccaccacctggggcacacccagattgattacattgagagtggtgagaatgctcacatccaccttgtcaccgatgcagaccaccaccacatcgcagttctgtattcctgtctcacgcagtgtctccttctgcaaatcctttaccacatacgcatgttccgtatagtttctggcctgcctgattttttcctcgcttctgtccagcaccataagctccttatccgcctctgccagggttgccgccagtgcgcttccaaaccttcccagacctatgattccataggacattgcctctgtctgttttcgtgccatatataaaacctcctctatccattcaaaatgtgcttaccgctatttcacttatcttcccctatccgatggaaatgcttccttccgcataggatacggatttagtgggtttgaatacccaaatcgtcacaatggtcagcggccccagtctgccgatatacattaccagcacctccagaagcttgctgagggagctgagtcccggcgtaatgccggtggacagacccacggttccgaaagccgatgtgatttcaaacagaatatcctcaaaaggaatcccaggctccaggatacacatgaaaaaggttcccaggcacaccaccagggccgacagcgccgtcacaatggctgccttgtaaaatgcctcctggggaatccggtaatggaaggcatggggctcctcattgcaggcagcacctttgatggtatgaaacaaagtaaataaggtgctggtcttgatgccgcctcctgtggaccccggtgaagcgccgatgaacatgagcacggaaacgctcagcagtccggcggaagtgaattctcccagaggaaatgtggaaaagcccgctgtcctggccgatacactggtaaagaacgcgcccagccaggtaatatcctctgtcagccaaatcagtactgtgccggatgccaaaagtatcagggttgtcacaatcaccgccttggagtgaaggcacagctttttaaaggagcggttctttatcaaatccatgatgaccaggaagcccagccctccaaatataatcagtcctgccgtagtcaggttcagcagcacattgtcctggtatcccgtcaggtttttaagtccccccagtatatcaaatcccgaattgttaaacgcggccacagagtggaacaggctgatgccaaccgcctttaagggcggataatccctggaaaataccaggaagcttaagacagctcccacgccctcaaaacaaagggtggtaatcagtacatttctcaccagacacacgattcccctgccagaatccaggttaagggcttcctttaccagaaggcgttcctttaaattcaccctttttccaagagccagaatcacgcccacgcccactgaggtcacacccagaccgccgatctgaatcaaaagagccaccacggtctggcccagagccgtataggtatcggctgtgtccacggctataagaccggtaacacacactgcgctggtggatgtaaacagagcatccacataatgaagcctgactcccggctttatacacaccggcagcatcagcaaaaaagatcctgtaaggataacggccagaaaaccaatggcaatgattctggccggagactgcctttccagatacttcatataatcacctcctagtgccttcaagcttaccactaagggcataaagcaggtataacggaaccgcctccggtataaagattatataaatattatataaagatacagtcatttaacccaaagatatgatatactgtccgggtagacaatgaaggaggtttttcattccatggcccattcccgaatccttgacaccctaaaaaccttggcagtcctggccgcagccactgccattggattcctgttagaaacccttggcctgtcccaggccaacatcattaccgtatatattctgggagtcctggtggtggcggcagtcacagccagccgctggtacagcatcagcgcttccctggccagcgtactgctgttcaactacatatttacagagcccatgttcgtcctgaaggcagaagacgcaggcacccagcttacccttctgattacatttctggcagctgtatttaccagttccttcaccgtgcagatgaaagaaaaggcacggctttcccaacaggatgcctaccgctccggcgtcatcctggacaccagccagatgctccagaaggccgctgcaccggcggatatcctgacctgtaccgccatacagctgaacaagctgctcaaaagggacattacctgctttgaacaggatggagccagccttaagtcccccctttgtttccgtgagtactcttctcccgcaacaggaaggggaccggcccctgacaccttagaggaactgactgctgcccggaaatgctttcaggagggaaaggaaacaggggctgccacagggctgtttcctgcagcagcttaccacttcctgccccttcaaagctcaggcgctgtctatggcgtcatgggaatccatgtgggcaccacgcctcccggcgactttgaaaacagtctggcagtagccatcatagcccagtgttccatggcgctggaaaaagaatatatttccaggaagcgggaggaggaagcggccatggcccgggcagaacagctccggagcaatctgctgcgttccatctcccatgacctgcgcaccccgctcaccagcatatccggcaatgcaggtgtcctgatgagcgatggggagaacctgtcggccgaacaccggagccggatatacagggacatatacgatgattccatgtggcttatcaatctggtggaaaaccttctgtccatcacccgtatggaaggccagggcgtccacctgcacatggaaaccgaattgctggaggaagtcatagacgaagccatgcgccatatcaaccggcgtcacgaacaccacaccatcagggtaaatcaggtgggtgactatatcctggctgacatggatgccaggctgattatacaagtcataaccaacctggtggacaatgcggtgaagtacacgccggaaggttccaccatcatggtaaacagccgccaggaaggcgcctctgccgtcattgacgtcagcgacaacgggcccggtattcccgatgagtcaaaggaaaagatttttgaaatgttctataccaccggtcacaaatccgcggacggaaagcggggcatgggactgggactgcccctttgcagggcaatactgagcgcccacaagggcaccatcgaagttttagacaacaaacctgccggaagcatattccggcttacattaccagccaaggaggtatccttacatgaataagccatccatcctgattatagaggatgacaaagcagtgaaaaatctcatcgccaccaccctggagatgcacgattaccattatatatgggcggataagggagaacagggcatcctgtccgctgcttcccagagacctgacatcatcttactggacctggggcttccggacatggacggagtggacgtgattcttaaaatccgttcctggaccaatacccccattattgtcatcagcgccagaagcgaggacagcgacaagatagcggccctggacgccggggcggacgactatttgaccaagcctttttccgtggacgagcttttagccagactccgctccacccagagacggttaagctatatgcagtccctggaggaagtacagacctccctgtttgccaacggcgggctgaccattgactatgcggcgggatgcgcctgcctggacggggaggaactgcacctgactccctatgaatacaagcttctctgcctccttgcccacaatgtgggaaaggtcctgacccactcctacataacccgggaaatatggggcgctgcctgggaaggggacgtggcctccctccgcgttttcatggcctccctgcggaaaaagattgaaaaaaatccctcacagccccagtacatccagacccacgtgggagtgggttaccggatgatgaagcggtaagggattatacaaccaatagatgaaatccgatggtatttatgtcattatttatgtcatgaaacccttcagagcccagtcatatgtatccatggcctgctggaagcctgtgtctgccctttctttggcagcggcggcatccatgtaggccgcttttgcctccagatattcctggcgcgacagcattcccagggccagcttgttggatgctgcctggaacgcggcttcctgggatgccatggacgttgctgcgctggtccagagtgtctggctggccaggacatcctgatacagtgtatccagctggccgtacatagcctcctcactctggcggatatcccgctggcgggcatggagttctttattggagctggctcctccgctcctctgttccctcagggaataattgttgcccagcgcgcgccatttgtcggtgctgcctcccatttccaggacacgctcaggccggggcgctggcatgggaccgacttctgcctgggagccttccggatatccggtgagaatgaataattccttcttcacccgttccatctcgtcctgtacagcctttgccttggcagttgccgcatcagcctcttttcctgcctggtccgcctgggcggcagaggcgcttcctgtctggacctggcgcagcagcttctcatactggctctgtttccactctgcctgagccaaagccgcatcctgttccgctttaagggtattataggtgcccataagattctgggctgtccagagtacggtatcctctatcctgcgaagggacatggacgcctggctgccctgggcagagcggatctgcttatccatatccttggccgcatcctccagggtcttggcctgggcccggtactggccggcactgtctttgtccccgttcttctccaggtcctcggcctcctccctgagaagacgtctggtttccatgatttcctccctggcattctcgtaccgcgccaggcggctgtcatactgcgcctgttccatctgtatctgggggctgctggcttttaccagcgtctctaactcctcataacgaatgacatcgggcattgcatctgcatgggcctccagagggtacaggcaggcaaagaagaggcccatgaagagcagtaagtattttttcaccatatcctatgccccctctgtctgtgcaaggccgttgaccgcccatctgtaatcctccagggcctgcctgtatttcaggcctgccgtgtcgcatgcggactggctggaggccatggttccctgctgctgtatatattcatttttggaaatcatgcccaggctgtatttgcgctcggctgtctgggccccggtacgggccagctccagctcgcccgccgcctgttcataatcagccctggcctgctccaaaagcttatatctggcctccacatccgcctcaatctgcctgcggccagtctccaccttttggttcatcacatcccactgggtcccgttgcctgtaaatgtcagacggcgctcattggctgtctgggtaaagttctgctctatggccctttccttatcaaactccaggtcaatctgatccatctccccggcatccggcaccggcacttccctgatatccggctgggcattgtgatcccaacccgtcatgacgcagagctctctgcgcagtccgtccctctccctgtcattggtctccagggctgcctgggctgcctccatcttttcccgggccccaagcagctcagcctgggtagccatgccctggcctgctttcactgccatggcctcatactttgacctggcctggttcacatcctcctccagggcaggacgcgccttggccttctgccagtaggatatcatctttgtctgggcatcctttacaagaacagcctcctgtctgtcgtactccagcttcttcacccgtccgtcctcattctgtgaatcagccagctcctggttctgttcagcctgcaggcgggcgcttatggcccccaccgctgttcccgcatatcccggctggtcctcattgacggaatccattatcttatcgctggaatcatagagcctgtcagcaatatcctggtaggcatttttcatttcatcgtggtccttgcccctgtagtcgtcgtattccagacggttattgataaccgtggcattgtattcgtggaccaggtcagccagctccccgtattccagcacatcatccctcagcgccgcccatttgtccgcagaataggcaaactccgggctggcccatgcagtcaccggccgcagcatgcccggaaccggggccagcatcagggccaatcccatggctcctgctctcttccatgtaccgctcatccgtctcacttgctttcctcctgtctcgattcttgatttcctccggccgcatcctttgatatcctccagccgcatcattgatttcctccggccgcatccttgatttgctccgtcgggatatcccgtctattcgtaacgcagcgcgtctatcgggtctgccttggctgccttggatgcaggatataatccaaagaagataccgaccactgctgaaaatgacactgcaaccacgatgacccccggttttatgaccaccgcaaatcccagaaggaatcctcccagggatacggttcccactcccagtatgacaccgataatgccgccgcaggctgacaatatggctgactccgtcaaaaactgtattaacacatccctggtccttgctccaagggctttccggatgccgatttccctggtacgctccgtcacggacaccagcatgatattcataatgccgattccgcccaccatcagcgaaatggccgcgataccgcccactgccatggacaggctgcccatcatgctgtccactgaggtcatttcctgcatggccgtatacatgtacatatcctccggctgcctgccgtgcatcttggccgcatatgccttgaactggctgaaaaactggtccaggttcacatcgtcctttgcatacacatgaagctggtaaaaatagtcgttgggccaggtcagaagggtgtatggaatgaatgccgaccccttgtcatcgctgttgcccatcatcagggcctggaaggcgttgacctccttgcggtacacacccaccaccgtaaagtcgtcggtagagccatataaggtggttctgaaggaccgcccaaccgcattctcagtgccgaacagcatctgggcgctcttggtatccatgaccacattcttccttcttcccaggatgtctccctcgttgagatagcggccgtacaccacgttcaccggctgcacatcctggtaattgtagtcaattccctgatagtcaaatttaatcttagtccgcttatactcggcatcactgctggtataggcgctgctgtctatataggcgacctggtccttaaaggcctccttggcccgctccatctcgtccagggtaaaataatcgctctgccgcacatcatctacccagtaaccaatggatatataggcctgggtaatacccacatccttgtataaatcagagaaaagtccgcgcatggtatctccgatggacacgatggctatgacggaaccaatgccgatgatgattcccagcatagtcagggcggaacgcatcttattggaccggatggctgaaaatgccatcttcatgttttcaatcagcattctgctctccccccttcccgtcctcagaagtcaccctggccgcattcaatttgtcactctgtatctgcccgtcgctgaaccgtatcacgcggtgggcaaaggctgctatatcctcctcatgggtaaccagcaccacggtagccccttcctggtgaagctttgtaaacagctccatgatttccaccgaggaggcggtatccaggtttcctgtgggctcgtctgccagaattaagggcggttcattggcaagggctctggctatggcaaccctctgcctctgacctccggagagctcgtttggcatatgttccttcctggctcccagccccacccgttccaatagcagctgggccctgaccgcccgtttggcctttggcaccctggcataggtcatgggcagctccacattcttaagggccgatgtcctggatatcaggttaaaggactggaacacaaacccgattttccggttcctgatatcggagagctggtccggcgtcatgtctgccacgtcaatgccgtccaggtagtaatgtcccagggtgggccggtccagacacccgagtatgttcatcagggtggattttccggatccggagtgtcccatgatggccacaaactccccccgttcaatggtaaggtttattttctttagtcccagtaccttaatggccccggtatcatatatcttgaccagattctccagcttaatcaggggtccgtcatagacctcttccttaatcatgctgtccctgtgtaaaaacttcatccacttcttcatacggcgcctcctgctactgggtaatcagcacggcagcaccgtccatgagatggggtcccggattggtgataacctgcattccctcctccagcactgtaccgtctgtgggaatgacctctaccaccacgtcgccgtctactcccatggtcacaggtattcgtttaaccttcatatcctgcacaatggctatgtatgtcacttccccgtcgtcaaaaagcgccgatgagggaacgacgaaaacatcctttgcctccctgattaaaagttctgcttttgccgtgattcccgcaataagctttgagcttccaccgtccacccgtatggtagtgggaataaccctctccgtggatccgccgcctttttcctcgcctgtgggcgatatctttacgacctcgccttctgcagtctcaccgtccaggatatccgctgtgatggtcgccatctgtcccacctttaccttgccgatggagaactcgcttaccttgatttccagctccagctgctccagattctcgatgctgagaataggtttatcatcctccaccttatccgcaaactggcccaccttggaattgacacggaccacagtgccgtcaatggtgctctttatctgggtattatccagttcttcttttttcttttccaaatcaaaggctgcgttctgtatctgtatgccgtaggacgaatctgcaacgcctctcccattctcaaccgtatagccttccatctgccttctggcgtcattcagggcattggcgctggcttccagctccatctgtgaaatgtcgccggtagcaaagagctggctgttcctgctgtgatccaggctggccttctggaaatcctggaccgccttttcgtatccaagggctgcttccttatctttttcctgcttattagccaccgcaaggtcgtaggcgttctgggcaatctgcacttcccgctccagatccgtgctgtccaccacggccagcacctgtccttttgtcacggtatcaccctccttcacattcatagcagtgatttccgcatgaatattggacaccacatccacgctgtctgtgcctgatacaggaccgcttaccgtaagcttttcctgaacgtcctgtttggcaaggggcatcacggcaaccgggatccccagatccttctttcctccggacatacgggagaacccaaacaaaaccactgccgccagtaccaggaccgtgattatcttgcgcttacggctgaaccccttaaagcgccggacggggtgaaagcccccctccgatgaccggtgtccggtcttttgcttttgctttttcttctttttctttccgtttccttcctcctccggagccatcagctcctccacacggcggtcaatttcctcagactctgaaatgccttccaaaacctggatttcctctaaatcaccagcttttttctctgttcccatgactccctccttaataccagcggatactgtattatttatattaatacagttatatcacatatggcatacttatacaacaaaaaataaacatttgcgccattgctgttcatttaataaggctattatataggtttgccataaatatttcatcctgtattttcataacatttcataaatgaaaacgaaagatttacttaaggaaaggggcaaccatacaaaaaaacggcaggtccctgtaacacaggtatttcctgccgcctttggcgggcagggcatcttcctttgccctccccgcctattcttactttgaaaccgactctttctctaaatcaattccctggtccgttaccgttactctgctgcttattctctgctctgctgcttattccctgtgctgttaccgattccctactctgctgccgctgccctaagacgtttcatcatctcatccacatccgccttctcaatcaccagaggcggaacgaaacggatgatattggtcccggcgctgattaacaccagcttctgctccagcagcgcttttgacacaatggggcctgccggtacagagaactccagaccctgaatcaatcccattccccggtgtgccctgatgcaatccagttcctttgacagctcctccagcttctcgtagagataggcgccaatctcctttacatgttccgtgatacggcgtttctcaaaaatatcaagcactgcgctggctcccgccgtcaccagcggattgccgccataggtggtgccgtggtcgcccggaaccattgcgctggccgccttgccccatgccaggaaggcacctatgggaagcccgtttcccagcgccttggccactgtcatcacgtccggcttcacgccgtaatgctgccaggcaaacatttccccggaacggcccatgccgcactggatttcatccagtataaggagcaggtcatgttcatcgcacagggccctgaccccttttatgaattcttccgttgcaggatagatacctccctctccctggatggtctccatgatgaccgcacatgtcttactgttaatcagcttcttcacgctgtccaggtcattgaaatcagcgaagcggattcccggtataagaggcttaaagggctcctggtagtgggcattgccggtgacggacagggcgcccaggctccttccatggaaggaatggttcatggcaatgatttccccggtcatgtccggctccgcgtcctcgcagccgtcgcagccgtctcccatggtttcatgaagtttgttatagtgatagcgctttgcaatcttaagagccccctcaatggcctcggtaccgctgtttgtgaaaaacaccttatccatatgggatacctgaagcagcttctcgccggcctcaatggagggctggttgtagaacagattggagatatgggtcagcttgtgaagctgttcctccacggcctttgtatactcctcatccccatagcccagcgccatgaccgcaatgccagcgccgaaatccagatactcgtttccctctgtatcgtaaagcttcactccctccccatggtcaaacaccacagggaaccggttgtacaccttataaagggcctgttctgcccgttccatcaactgtttatcagccatgataatacctctcatcttcttcggaattatagatagcggttccaatacccttgtcagtaaagatttccagcagcaggcaatgaggaatacgtccgtccaggatatgcaccctggatacgccgttttttatggcgttgatgcagttttgaagcttgggaagcataccgcctcccagcattccgctgtccacaaaattctgggcctcctccaccgtcatctcggaaataagagaggacttatcctcataatccttatacacgccctccacatccgtgagaaaagcaagcttttccgcctccactgccgtggcaatggcacaggccgcgtcatccgcattgatgttatagctcaggaaatcctcatcaaagccaatgggacagatgatgggcagaaaatccttttccagcaaatcatatatgattttgggattcacttcctccacatctcccacaaacccgatgtcctctccgccggcgtatttcttacggcatttaagcatcatgccgtccttgccgctgattcccaccgcattgatgcccagctcactgaccagctggaccaggctcttattgactttattaaggaccatctcggcaatctccatggtgggttcgtctgtaaccctgagtccgttcttaaattgggcctccattcccaccttgcctacccagcggctgatctccttcccgcctccgtgcacaatgatgggcttaaagcctaccagcttaagaagcaccacatcctgtataacctttttcttcagttcctcatccaccatggcgcttccgccgtattttaccaccacgattttcctgttaaaacgctggatataaggcagtgcctcaataagcacggccgccttctgcattggttccaaattcattttcatactcctccttatgagcactgagcgcctgtctttcaggcgcttacgtgcgatacatgtcactggcacttagcaggtctttttcgggctcagtgcagtggctcgttatgagcacttagcgcctgtccttcaggcgcttacgtgcgatacatgtcactggcacttggcgaggtctttttcgagcttagtgcagtggctcgttatgagcggtaatccgcattaatcttaacatagtcaaaggtcaggtcgcagccccacgcagcggcctttgcatcccccatcttgatgtcggccacagccgtcacctccggctctgacagtatccgggtagcctgctcctcgctgtagtccacggccacgccgtccttaataatctgcatctttcctgccgcgctctcaaaatacaggtccaccttttccggatcaaactgtgccccggaataacccatggcgcagagtatcctgccccagttggcgtcatggccgaagatggctgccttggtaaggctggagcagattactgattttgccagaatcttggcctgttccttagtctctgcccccactacctttacctcaaacagagcggtgcagccctcgccgtcgcctgccattttcttggctaatgtttcgtttacaatctttaaggctctgcagaaggtatggtaatcctcattcttctctgtaatttctttgttgccggccagaccgtttgccagaaggagaaccgtgtcattggtggatgtgtccccatccacggaaatcatgttgtatgtatcctggatatcctggctgagtgcctcctggagcagctctttgctgatggccgcatccgtagtcacaaagcttagcatggtacacatattgggatgaatcataccggagcccttgcacatgcctcccatggtcaccgtggttcctcccagttcaaaccggacagccacctctttgttctttgtatccgtggtcataatggccctggatgcgcctgtgccgctttcaaggcttccgtccagcaaaggagccatggccttgacccctgccgtaatcctgtccatgggcagctgcatgccgatgacgcctgtggatgccaccaggacgctttcagcagatattcccagggccagggccgctgcctctgctgtctgtccgcagtaccccatgccttcctctccggtgcaggcattggcaatgcctgcgtttataaccactgcccgggcaggcgccccgcttgtcacctggttcttatcccattttacaggagccgccttcacaatattggtggtgaaggttcctgccgaccggcagggctcctggctataaatcatagccatgtcctgacggtccttatatttgattccggctgctgttgaagcagccttaaagcccctggcagccgtgacgccgccggttatgattttgattcccatgcctgtctcatccatatcactcattcctccatttatttccatacctttatgtcatatgaagatgcacctgcctttatcatggtgcaccatcctttcattttaccgtacaaaccgggtgatgttttcctcattcagtatgaattcgtatgtattcacatcctcccgttcctgccacccaattccctgccagaacgcatttcccacctcattacccttaaacgcaatcaggctgattttgctgactccttctttctgaagggcctccatggcaaagcgcaccatgcggtatccaatgccgtgtttcctgtatcccggcgccacgcacacgtgataaaagcagccggtcctgccgtcatggccgcagaggatatttcctataatatgaccgttctggacagccactacactggtagtgggattcctcccaagaaagcgctccacgccctcccgtgaatcgtcaatacttctgattccaaagcccttgatttctgtccacaggccgtagacctggtcgtaatccgctattgtcatttcgcggataaggatatccattgtacctgccatgatctcatatttcctttctctttccctctttcatccttttcagagatgtctttaaaccaacagcctgaaccatcaggggaaaatgggaatctgcttaagccccgtattctccggcaggccgaacatcaggttcatgttctgtatggcctggcctgccgctcctttgaccatgttgtcaatggctcccatcataaccacccggttggtcctggtgtctatcttgaaattcacgtctgcaaaattgctgccctccacccaccgggtctggggcaccacatccttttccaggacacgcacaaaatattcatccccataatatttatcgtacacagcctttacctcctcgcaggatacttcctttgtaagggatgcataggctgtcaccaggattccgcggttcatgggtaccaggtgaggggtgaagctgatggttaccggttttcctgctgcataggacagctgctcctctatctccggcgtatgtctgtgggaggccaccccgtaagccttaatgttctcattgacctcacagtacagactgtccaccttgcttcccctgcctgcgccggatgtgcctgacttggcatcaatgataagggtattggggtcaataagcccttcctttaccagaggataggtggacaggaaggagcaggtggggaaacatccaggattggcaatgagcctggctttcttcaccttttcccggttgatttcaggcagcccgtatacggcctcaccgataaactgcggggatgcatgggtcagcttataccatttctcataaaccgacacatccttaatacggaagtcggcgcttaaatcaatgacctttactttagataatacgtcctcgtccatcagggatgcgcacagtccctgaggggtggcggtgaacaccacatccacctgttctgccagctccttcatattatcatccatacacacatcgtccacgattcggaacatgttctggtagatggatgcatatttctggtctatgtagcttctggaaccataccatttaatctctatgtcatccctctggagcaggagccttgccagctctcctcccgcatatcctgtggaaccgataatacctgccttaatcatatccgtatctccttatatttataaatattggctgctgccttcattatagtcagtttttctttaaatgaaaagaagcatttctgtgaaccctgtttcctggttcccgtttagatttcataattatacattacaaatgcataatatgcaatatcttttaaatatttttatttagcacttgcattttatcacataatgttgtatatttatgaaagttcaatcagtacagcaatctcaggaggatatcaatatgaaagaaaaagtagttttagcttattccggcggactggataccaccgcaatcattccgtggttaaaggagcattttggttatgaagtcatctgctgctgcattgactgcggtcagggcagcgaattagacggactggacgagagagccaaattatccggtgcctccaaattatatatcgaagatttagtggatgatttctgcgacaattacatcatgccctgcgtaaaggccaatgcagtatatgaaaacaaatacctcttaggcacctccatggcccgtcctgccattgccaagagactggttgatattgcacgtaaagaaggcgcctcagccatatgccacggcgctaccggcaagggcaatgaccagattcgttttgagctgggtatcaaggccctggccccggatatcaagatcatcgctccctggcgcatgaccgatgtatggaccatgcagtcccgcgaggacgagattgaatactgcaagcagcacggcattgacctgcccttctccgcagacagcagctacagccgtgacaggaacttatggcatatcagccatgagggcctggagttggaagatccatcacaggaacccaactacgagcatctgcttgtacttggcgtgactcccgaaaaagcaccggatgagggcgagtatgtgaccatgacctttgaaaaaggcgttcccaccagcgtaaacggacagaagatgaaggtttccgatattatccgcaaattaaatgagctgggcggaaaacacggcatcggcattgtggacatcgtggaaaaccgtgtggttggcatgaagtcccgcggcgtgtatgagacaccaggcggaaccattctcatggaggcccatcagcagttagaggagctggtattagaccgtgccaccatggagacgaaaaagaccatggctgataagctggcccaaattgtttatgagggcaagtggtttacacctctgcgcgaggctgtccaggcatttgttgagtccacccaggaatatgtgacaggcgaagtaaaattcaaactgtacaagggcaatatcatcaaggccggaaccacatccccatactccttatacagtgagtccctggcttccttcaccacaggcgacctgtacgaccatcatgacgcagacggcttcattaccctgttcggactgccccttaaggtaagggctatgaaaatggctgaggtggaatctgccaaaaaaggccagtaaagagacaggatgcactgttacacataaagaaatgccccggagatgttacattttccatctccggggcatttctttatgatgctgatcagattggccagcatttcactctcttaggaaaggactcaatctgtttccatggaaagacagcgccgtgtccgctgttctccccctgcatccgatccgctcaggagcaaggttatggataagggaatccggcccggcattggctttcctgaatttccttagagcctttttaacttgaaaaaccggtaatatattaaaaaatatacgaatatataaccttaaatctgcatagatcctcttcttttttcccaaaatgtgtcgaatatataagatagtatgtatattaaatccatcagcacaaaagaggggtaaaaggaagatgaaaagtataaaaggaaaaattttattatgcatgtcactgactgttgtcatctgcctgagcattttagggggcgcaggcatctgtctgaattacagcagtaccaatcagctgttggagcagacgctcagggaaaccgtcaaaatcgcgtccgacaaggttgcaaatgaacttacatcctatcttaacgtggctatcgacacaggaaccattgcgcggctgacggatccccagcagagcactgggaataagcagcttctgattgatgacaaggtaaaacagtacggtttccagagagggaacatcatagggccggatggaatcagcgcccttgacggcaaggactattctgaccgggattatttccataaagccatggccggccaggccaatatatccgatcctttggtcagcaaagtcaacggagaactgtccattattgtggctgctcccttatggaaggacggacggcctaatacaacaatcgcaggcgtggtattctttgttccgcagagtacatttttaaatgatattgtttcgcaagtgcacatcagcgataacagcgcagcttatgccatcaattcagatggttataccattgcggacaacaccaccagcacaatcatgacacaaaacatagaagaggaagcgaaatccgattcatcactggccaggctggctgccatacatggaaaaataaggaagggagaaagcggctttgacaagtatgaaattaacggtgtgcagaagctggctgcctactctccaatcgccggcacagacggatggggcatggccatcacggcacccacatcggattttatgggagcgacccttacttccattggaatcacatgcgctctgttagtaatatcactgattgctgcagtggcaatcgcttattggctggccaggaaaatcggcaatcccatccacatctgcacggaaaggatccagaaactgtcggaaggtgacttaaagtcgcaggtgccagtcatacattccaaagacgaaacgggcagactatccgaggccacccgtctcattactgattccataagcaatattatcaatgatattgactggggactgagcgagatggccgcaggtaactttgccatcaccagccagtcccaggatttatatgtgggggattttaaatcactctccgactccatgtacaaaatattaaaggagatatcagcagttttaaggaacattgaccagagtgccgaacaggtggccggcggctctgaacaggtggcggcaggagcccaggcactctcccagggggcgaccgagcaggcatcctccatagaggaattagctgctactgtaaacgagatttccaatcatatagataaaaatgccggcaacgcgaaaacagccagcgaaaaagctgcctccgtaatggaccaggcaaaagaaagcagccagcgcatgaaggaaatgctgacagccatggatgacatcaatcaagggtccggtgaaatcagtaagatcataaagacaattgaggatatcgcgttccagacaaatatcctggcgctgaacgccgcggtagaagccgcccgggcaggagaggcaggcaaagggttcgcggtggtggcggacgaggtacgcaatcttgcaggaaaatccgccgatgcttctaaaaatacatcatcactgattgagggatcccttcatgcggtggaacgcggcaccaaaatcgccagtgagacagccttggcgctggacgaagtggtaaatggcgttgaggatgtatccgcggccatcaatgagatttccgcggccagtgcagaccaggcgtcctccgccagacaggtcacacagggcatagaccagatttccagcgttgtccagacaaattcagctacagcacaggaaagcgcggctgccagcgaagagttgtccgggcaggcccagattctcaaaaatctggttgggcagtttaagtttggcagcacggaagccggggaggagcccgtgatgccggtcccagatgagtccaattacatggttcagggatgtgacgaaactaaatattaatattgcaggaaaggaccgcttattaaatgaaaagccgatgatttcatccgtatctgtgaaatcaccggcttttattccggctctttgctgccggctgctcctgccgccaggaattccctttcaccgccgtcaatccaggcggatcttgtttttctccacatccagcccctccggcatattgacaatccggatccttccgtcaatggcgaccggctcaagcactccgttttcactatggctctcaatataagcaatcaccgcgtcaatgatgttgggctgatttctggcccagtccgttatctgctgatactgctcgtcataggtatccgtactcaggtcaaataacctgcaggcgctctcatttccagggtcaaagctctggtagagggcaatcccctcaggcagctgtgccggcttgtccggagggagcaccgtaaacgcgtcccagccgtcgcttccccccagctcatagtccgtggtcgccaccgtataccaggcgtcagggtctactggttctccgtttaacaggcggacatcgctgatttccgcctgtcccccatacgcattatcctccagcggttcgtaggtaatggtataggtgaagccggagggaatcaccatgccgccgaacacactggactggtccgctctcaccgcatcggtcaggttattggtggagagtatggatatcaggttggcgcccttgcagcgcacagtgaccacatggttgttcaggccgtagagcatggaggtggccaaatcagactctgttatctccccttcctcaagctctgctgtcagagttcctgcattgatggcggccagatctgcgcccgtgtactggcgcagggcatcagccagcaggtttcccagagctgattcattggagcgggaaaatatacgcacataattgtatgtcttatctgtcttcccgaccacatggtccgggacctggtaacggtttttccctgttgtgcggtattcttccagcgcctccagcatcccctctgtgccgccaatcttcatgtaggagctggcgccttccagacctgcataatagttctgtccgcacaggtaatggcgcagggcaaaggtaaacaaatccgaaccgtaaaactggtaaggatttttcacaatggagtgttctgtaaggcactggtaaaattcaggatgggtattctgaaaataatcataatttaatgtgtcatcccgccggtagaaggtggtagcgcccacgggaaccgaagcactgtaatattccggcgcaaactctgtggaggccacatattccagatacaggcggcaggccctgaggacagtctcgtctgttatgtttgcattgattcccagataccagtccccgttggtggccagccagcgatcctccctggttcttcccatatatggtatgaatacaaagtcctcggccttcacccatacctgtttgccgtccttttctattttaaagcttgggaccccgttcacatccctgagcttctcttcaaaatgaaccgcatagtccacatagctcaccgaacacatgactgcgttcccccgaaccacctcccgcagattctgtttgctgctcatcagaaagtcgccgttctcatacagccccatgctttccagctcatcaattcccttaaggacacgggcaaatgccggattttcaaaggaaacccctgccggattattccggtacagattcagccactgcacatattcgctgtccgtgtacgcatccagaagaaagggcatggccaccactgctgctgcgtcattgtaaagcatcccaaaggcataggcacgtaccccggtctcctcccttctctcctgaatccggcggcagagccccataaactcttcctgtgtccggggcatatcatatcccatatctgccaggagctgtctgttcaccatcagccctgagatatacccgtttccaaccgggagggcatataccttcccccctacctccgcatcatttaaggcgctgatcatgtagttcttcaaaaatggttcggaggtcaaatccttcagataaccgctctggacataggtataataatcctgtgtatagaggatttccgggccgcctccgctgcgcaccgccgccagctgggcattctccatctttggcgctatttcatatgtgctctcaattttaactccgggcatcgtgcggtggatataggcttccgcctgctccgtattgatattctcacccatggtattgtacacatgcagcacaaccggctcctcagccggcggcgcaccgctctgtttcttatcctctgtggccccggtatcccaaacagccgtgcatccggtagcagcggatatcagcaccagcaccagaagcagccctattcccatccgtttcttcatatttattctccctcttccccgggtatggttttcgttaatcacgtttcgctgccgtaccgggtatcctcctgtccagccctacagctccagccccacagctccggccgtaccggctgcccaagccgttcagggacagcccttttagcccagcaggccccgcagctgttccatattgatgggctttgtcagtacagcgccgaatcctgcccgcgccgcctctgaccgcacttcatcctcactgctggatgtacacgcaaaaacaggaatggttccggcactttttctttggctgccgcggatagctgccgctgcctcaaagccgtccataaccggcatacgcaaatccagcaggatggcgtcatatgtgccgtccggagcattgagatatgcctccagtgcctggcgtccattttccaccgcatccacctgctgtccgtcggcccgtatcagctctgctgctatctcacggttaagttcattgtcctctgccaacaaaagccgcaggctgcggccctcacgccgcacccgcccaatctcctttgccaggaccgcgaagtctatgggctttggaacaaaaccattcatccctgcctcaagagcttccctgcgatcctcctcaaaggcattggctgtcagggctataatagggatggacgctgcctggggatggatgctctcccgtatcctgcgggccgcatccagtcctcccagaaccggcatctgtaaatccatgagaatcacgtcatatgtatcctcaggtgcatccagaaaacgggtgcatccctcttctccgttccgggcagtatccaccgccgctcccatgagtccggagagcatttccactgcgatttccaggttgaccgcattgtcctccaccaccagcaaacgcacgccttttaactcccctgccagtccgccggatatgctctccccctgtcccagcattccggtaattttccggtacaggctcatccggaacagaggcaggctgattgtatatttaaatcccttctgcttaatctcctcaaacagctcctgctcatccggtttcagtcccagaagtaaaagcgtatccccgcctaaatcccgcttcagctgttctccggttaaggtccggtcaaagcggagcattttatagggaagaaataccatggagaaaggacggcccgccgccctcttttgggccgccagggagacggctgcctgataatctgtctcccaggcagcatccacaccgatttcctccagcttttccactgcatccctgcacttttcctcacttcccggctcgccgatgaccagcatggcgcagcctgcggccagaggcacatggcggctgcttaaacggatggatagcccaatggtaaaggtggtgccctttcccggctcgctctccacccggatggtgccgcccatcagatccacaatacgcttggtaatggccatgcccaggccggttccctggattccctgtttataagaattctggtcccgtgaaaacatctcaaaaatccggcccatatattcccggctcatgcccacgccggtatcgctgacccggaatacaaagctggcaaatgaaggatcctgtgatggtacctctgtgatatccagatagatttccccgtcctttggcgtaaacttcaccgcatttcccagcacgttggtaagcacctgccccaggcgcactgtatcgccgcacagcaattcatgggtaatgttccagacattgacgtcaaaatgctggctgcgcacacctgtctgggactgggtcaccgtaaccacgccggacagccattcacccagttcaaactctgtctctgccagctgcattttaccggattctattttggacatgtccagcacatcgttaatcagtcccagcagtaattgggaggaattggcaattttttgaagacattccgtcacctttttgctgtcttccggtgaatagagggccagattggtcaggccgattaccgcgttcaggggcgtacggatatcatggctcatgctggccaggaaggtgctcttggcagcattggcccgggcctcgctctccagcgcctcctccaggcgcctgcgggactgctcccgttccgtgatatcctccaacgtcagagtgataaaacgctggctgctgtcctgttccgcaatcagataggcgttaagggacagcacgatatccctttgggtgtcgggccgggtaaaatgcagcttcaggcttccgcttacacactctccctcccggatccggctcatgagatccaggaccgcctggcggtcgctgccgctgatacagcttaagaacttctcttctatggcatttccaaacgcgtcctcaatccccaggacctgttccgtgttgcgggacgcatactcaatggcaccgctttcactgtcgccgataacgatgacattgggcacataatgggtcatcagtgtaaaaatccggtcgcggcgaacagcttccctggatgcattggcacgcaccacaaataccagcataattacaatcaccagaaacatgcccagcatcagcacaatgatgaacatagtcagctggatggtctcctggttaatctgtgccgcgtccgccgtaatgtggtcataggagacgcaggaaatgaactcccagccggtccgggggatgggcgcatacacaagttcataccgggaatccccaaaataaatctcggcgctgccgcccttatcgttcctgaattcagagagcacccgttcgtattccgtgccgccctgggcgtccggcttaaagaattccgcattcaggggattttcctcaaaatatgtaaacagattcagggtctctcccagttcccggttcacatgggtgcgggagagaatcagacctgagtcagtggtaatcatataggaagcattgtccccgaacgcagtggaatcatagagggcccggaaggattcctggctgtaaattccaatcagtatgacagagcccgcgcggcaggagaatgccaccacatcctgccccgaagcgctgaacgggtctgaaataaagctgatcgcctccccgtccgggctgttcaggcaatccacataggcctggctggaatacaggttgatgggtttcacactatccccctggctgtagacaccgcggcctgattcattcagaagtacgcagtaatcgaacacagacactttattaaaatccctgagataactgcggtccccgttgcttaggccgtcaatggagtcaaaaccattttccttcagttcttcggacatgccgattcccagcacgcgtatctcatgccggcaatggtcaaaaccttcggttgtcttggaaatcagggtgctggttgtctctttcagcgcagagatattggaattgatgatgcggtcgtagatgtccctgcggtatccttccaggaaataagataacgataagtaaaagacaatcgcaagggcgatacagactgtgatggttatgggcagagaaaacttatgtttttttcgtatctgtttcatctgccgtacctcgcttttccggaaaccatataactttaaacagctttgaataatattatattatttgggaagctatttgtcaattttacaaatacggacagtgctgcctgaatatatctttatcctgctttaaatgaaaccggacccatgaagaagcagtctgttcttcatgggtccggttttaactgccattgagcagcagctgtttatgtctacagtgacttcacggctgccacaacgttctcaaccgtaaatccgaatttcttaaagagctgtcccgccggtgcgctggcgccaaagcccttcatggtgacggtggttccgtcaaggcccacatacctgccccatccgaaatcgcccagtgcctctaccgccactctcttgcgaactgcctttggaaggaccttctccttgtaatcctcaggctgctcctcgaacacgtccatgctgggcatgctgacaacacgcacatccacgccctcttttgccagttctgcctttgcacccactgccagctccacctcggaaccagtggcaatgatgatggcatccggaacttcctttgcggaatcttccagtatataggctccctttaatgcctccttgctggatccggccagctgcggcaggttctgtcttgtgagtaccagagccgtaggagtctttttggaagatacggcgctgtaccatgcagcagctgtctccgtggcatccgccggacggtatacatggaagttaggcatggcgcgcagcatagccagctgctcgatgggctcatgggttggtccgtcctcgcccacgccgatgctgtcatgggtaaatacaaaggtaaggggcacacccataagagcggacagccttgccattggctttgtataatcgctgaacacaaagaaggtggacacaaatgcccgcaggccgccgtgaagcataagaccgtttccgatagcggacatggccagctcgcggacgccgaaatgcaggttgcgtccagcatagttatccttgaagaagtcccccatatcagccatataggtcttagtggagggagccaggtctgctgctcctccaatcaggttcggcatcaggttcttaagtttctgaagctgcttgccggacaggcttctggtagcatccggcttgtcctcaaatgcccagtagtcttcactgtcataaacatcattagccagattcggattatagaatttatcccataattccttcatctccggatatttcccgcagtattccgcaaataatgcgttccatttttcctctgtctcagcgcctctctcagcgtatgccttataattggcatatacctcatccggtacatagaaaggctccatggagggccagttcaggaattccttcatggcttttacattgtcatcccccagaggctcgccgtgagcgctggccttgccctgcttagcgggacagccgtagccaatctgggtctttacggtgatgaaggacggacgtgcggtatctgcctttgcctcctcgatggccttgccgatggcatccagatcattgccgtcctcaacggtaatcagctggaacccgaaggcttccatgcgcttttgtacattctctgtaaatgcgatatccgtgcttccctcgatggaaatacggttggaatcataaaatacaataagcttgcccagtcccagggtaccagccagtgagaatgcctcggaggaaatgccctccatcatgcagccgtcgccgcccagcacataggtataatggtcaacaaccggatatccgtccttgttgaatacagctgccagatgggactctgccatggccatgccgactgccatgcccatacctgcgcccagagggcctgtggtggcctcaacgcctactgtatgaccgtactccggatgtcccggtgtcagggaatccatctggcggaaattcatcatatcttcttttgtaaggccgtagccgaaaagatgaagcagggaatacagcaatgtggagccatggcctcctgaaagaatgaaacggtccctgttctcccatcccggattcttaggattatggttcatatgttttgcccacagctcaaaggacatggctgcggctcccaaaggaagacctgggtggcctgatttggctttctgtacagcatctgctgccagaacgcggattgcattgactgacatggtatcaatctgattcatagttccctccattccggtgcccccaagggggcccacgcatcatagatgttatttttttaccaactgccctttattataccaattccatccatgcagggcaatactttttctcgcaaaaatcagtgcaacattttgcggttctttgcgttattttgcaaatttaaaaacaattgttataaaaagattataatttaaacacattttcatcacattttaattttaaaactgtttggtgaatatgtttataaaaaactgacaggaggacacaatcagtgattgaagtaaaaaatcttgtaaaagattacggcggccatctggcagtggaccatttaagcttccgggtggaagacggccagatatacggcttcctgggccctaacggagccgggaagtccactaccatgaacatcatgaccggttatctgggcgccacagagggccaggtcatcatagacggccacgacatactggaagagcctgaagccgcaaaaaaacgcatcgggtatctgccggaaattccgcctctgtatatggatatgaccgtggatgagtacctggaatttgcggcctgccttaaaaagctgccgaaagcagagcagaaggacgctatacaggaagtgatggaactggttaagattacggacgtcagaaaacggctgatccgaaatctgtccaagggttaccgccagagggtgggtatggcccaggctattttagggaagccctctgttatcatcctggatgaacccactgtgggactggacccgaaacaaatcattgagatacgggatatgataaaggggttgggcaaacagcataccgtcatcctgagctcccacatcctgtctgaagtaagcgctgtctgcgaccatatcatgattattgcccacggaaagctgattgccagcgatactcctgaaaacctggaacaacggttaaaaggcgccgcgggcctggagctgacggtaaaaggcagcgaggaaacggtaaggcctgtgctggaggaaattcacggtctgtccatagagcgtatagggaccggaggcgaggcaggcacctgtgtggtgaatctgcagtatggcggggatgaagatagcagtgtttcggggaggggcattggttccggcggcggcattgctcccgacggcggcattgattccggcggcattggttccggcgctgatacagatatccgcgaaaccattttttacgccctggccaatcaccgacttcccatcctgtccatggctccatccaaggcatcccttgaagaaatattcctggagctgacagaggactccccaaaatggcgggaggacagaggcgccacagaccccacagacccatcaaaggaggaggattcccaatgagagctatctataagcgggagctgaaatcctatttctgctccatgacaggctatgttttcattgctttcatgaccatgttcatgggcatttatttcatggtttacaatatgattaacggttacccctatttttcctatacacttaattccatcctgatgatacttatgattgcggtgccgattctgaccatgcgcagcatgtcggatgaacacagggcgcggacagaccagctgcttctcacctcccctgtatccgtatggggcattgttatgggaaaatttctttccatggtcactattttggccgtccccatggccattgcctgcctctgtccccttatcatccgaagcgccggcaccgcttatctgaccgaggactatgcatctatactggctttcttccttttgggatgtgtgtatattgccattgggcttttcatctcctcccttacggaaagccagctcatagccgctgcagggaccttcggcatactgctgctcagcatcctctggccagggcttttaaactttataccggctgccgcagcaggttccctggccggtttccttatcctgtggaccctggtgtgttttatcatataccggctgaccggccatatccccctttccctcggactggaagcagccggagcggcagtccttataggaacctttttcgtaaagcagagcatgtttgaacgggctctgaccggacttctgggaaaaatcgtgctgacagacgtatttgacggtattgtcagcagccatatgctggatgtcagcggtcttgtctattatctgagtgtggccggtatattgctgttcctgacggtccagtcaatcgagaaaagaagatggagttgaatcatatgaccagaaaatgtaaaaaaggcagctatatggcactgttcacccttgtggtcattgccgctgtcattgtactcaacctgatagtgggaaagcttcctgccaaatacctgaaacatgacttaagttccaaccaaatccttactctgggggatacaaccagggacatcctggcacagctggacagagacgttaccatccatattgtggccgatcccaactcagtggatgagaggattacatcctttgtgaatctgtataaggacctttccccgcacatttcggtggaagccaatgaccctgtgcttcacccggatgtacttacttccctggacacagagcccggcaatctgattgtatcctgcgagtccaccggaaaaaagacatccatttcatttgacgatatcatccagtttgaccccatggtttactaccagtacgggcaaatcaaggaaacagcctttgacggtgaaggacagattaccagcgccatccgctatgtcacaagcgatacagcggcggccgtatataccctgaccggacacggggaaaccgccctctcgtcagccgtctcagatgccatggataaatccggcatgaaggcagccgatctgaatctgctcacccagggatccgttccccaggactgcagccttctcatcatgaacgctcctgtcaaggatatctccgcggatgaaaaagaaactctgaccgattacctgaaaaacggcggccgcatgctgcttcttgccggctgtacccaggatacattatccaatcttactgatttcatttcccagtacggaatggacctgaaaaatggatttgtggccgacccggctccccagcattactacaacaataatccctttaacgtaattccggattacgactttgccagcagccttctctcaggaattgattcctccgcagctgcccttctggtccagcctgcgggtatgaccatacaggaaaatccttcggaggacattgcggtccagcccttcctgactacctctgattctgcatttttagtggatcctgccacacaggaaaagacgcagggcacttatgtgctgggagctgtggccacggagactgtaaacgaggaagagggcacatcctccatgcttaccgtcatcacagcgccaagcatgattgatgattccatcctgtcacgtttccccagcatcaccaacctgactctgttcatgaacgccgcggccagcgggctgcccggagtcacaccgctgtccatccccagcaaaagtctggatattacctataatatggtaacatccgccggattgtggagtgcgctgtttattatcgtgattcctgtcattttcctgattgcaggctttgtaatctggctgaagcgccggaagctataaatcacgtttatacgcatcacatataacatgtatcgcatgtaagtgaccggaatacggtcacttacatgctcataaaaaggaggttaaacatgaagaaacgtatacggccgatggttcccgctctgggagccctggtccttctctgcgcagcatatggcgtcatcaactggcagcaggggaggaatgctgaatcacaggccctgtcaccggaaaatgcttctgtatatataaccgaccttccggagctgtcttccctgtcctggacaaaggccggcaagagtctgtcctttacccgggaaggcagtacctggtactataaaggggatacggactgccccatccgccaatatcccctgaccaccctgtcagatactctgtcccacttaaaagctgaacggaagctggaaggcgcggattctccggaagcatatggcctggataacccttccgtacggtttgataccgtttcctctgatggttcttctcactctatcctggtgggaagccaggttcccggtaccggcggttcaggcccggacggttcccagctccccgcccagtactatgcagctatgaacggggacagtcagatttataccatcggcagttatctgaccgaaacagctgccaagggactttatgattttgttgagacagaatctcttccccatgtggctggtgccgacatccgggaaatcactgtatccaggaacggacagaccagacggttctgtaagaagaccgtggatgacgcaggcaatatcgcctggtataaggactccgacgcggacgaggccaaccgcctggatgacaatggcgctcttaataatctggcggatgccataagcagtttgtcattccagtcctgtgtatcatataaggcaagcgatgaggaattgggcagctatggcctgtctgagccgattatgacgctttcctggacatatgaaaaagatggaaaagaagaaagccttaccctgacaataggaagtcaaaatcaggaagaaaccggatattatgtcagaaaaaccgcctcccgggcagtgaatctggctcccaaggaggcggtagaacgttgtcttaatgcttcgtatccccaataagacagcaatatcaaaactcatttaccacatacaggcctgcggcatataccttgccgcagtgcagggcatcagcggtccgctctcctttcgtttattccacacatgcggttgtctatgccagagcccatgcacgttctatgacccgctttgtatttgccaggattatatccgcatcctcgcactcccatggttttacttccgcagaaagtacataagggtccgaagccctaaaaaatccttcttccctcagaatacggaagaaatctgtcagttcattcacatcattggcgctgtccgggaatccgaagcgcggatgctggtctccatacgccctgcatccttttttcaccactgcatttccgatatgcaggtgtgttatatacggacgcagggtctgaatcacaaaacgggatgtctcataggtggttggaaaatgtgataaatccaccagaagtccaaagttggggcagaccactcttacatctgccgctaatcttgccgctaacggcgcaggtccaatgagtaccgccttatccatgtcaaaatcaaaaacctccaattccaccttcatccctttttctgccgcataccggcagacagaacaggttgttttaagaagctgggcataggcctccatgcgggtctgcggattccatttgccggccaggaaggcaattccctgcgcccccagatattccgcttcatccactgcctccatcaatgttttctcggccttcatccgtttctcttcgtccaatgcattagggttaaggccggggcccaaaagccggggctgtgcgccatagcaaactttcatatgggattgttccagaatttctctggcgttcaaccgcattccatcgtccggaatatgggtcaattccactgctgtaaaaaagggatcacaggccaattttttgagggaatccaaaaatggatatctctcaggcggataactcatccactcaatggttccaatttgaaaatatgtatgaattgattctttcatgatattgtcttctctcccttcatttttagcagcctctttgcctgcttaactatgttatcggtgcttattccgtacttttccagtaaaagtgcataaggtccgctctcaccaaaacagtcctccatccctatccgttttatggccacaggaaatacttctcccagcgtttctgcagcactgcttccaaggccgccgcagatgctgtgttcttctaccgtcaccagcagacctgtctttgccacggattccaacaaggtattcctgtcaaacggctttaccgtaatataatccagaatttcagcctctattccctccccttttaagatatccgctgcattcagaacagcagccaggggtgcgcccgtaactgcaatcgtcacatccttaccttcccggaccctctgtgctttccctatttcaatccttaaatcttcaggataaatccgtgaaacctcttgtcttgacagccttatatagacaggtccctcatactccatcatggcctttatggcctcttttgtgctggttatatcagatggtgatagtattgtgataccgggaatggaacgcagtactcccatgtcctctacggactggtggctggaaccatcggcaaaatccgacagtccgcaataacatccggccatcttaacattcagatgattatgggcaatcagactcctaacatcatctcccgcccggagcgcaaccagaaaagcaaaggcagccgctacaggaatcagaccagaggcagccattccgccggctattcccagcatattcccctccgcgattccacagttgaaaaagcgatccggataggcctgaccaaataatcgtgtctgtgtactggaggacgtatcactgtccagaacgaccatctgaggatactccgcccccagcaaaaccagttcttcgccaaataccgcccgcatggccttttgttccatactaatttgcctcctttcggacatactccactgctaaagactgcattgcgcaagactcttctgccccaagttctgccatagccgcttcatattcctgatctccaatcgtctttccatgccaagcacttttgccttccatgaaggagactcccttcccttttactgtgtaagcaagaataacacacggtcctctggtatctccagcctcattaaatgcattcatcaactggtccacatcatggccgtcgcagcagacagccttcagtccaaagctctggatcttatccctcaaactgcccataggcataatctcctgggctgtgccatccagctgaacccggttataatccacaatcaccgtcagattatggggcttccatttgttcatggccataaatgcctcccagttctgcccttcattcagctccccgtcaccgcacagtacaaataccctgtagctgtctccactgattccggatgccagagccattcctaaaccggctgaaatccccaatcccagagaaccggtggacaattcaatcccgggcaggcggtcacggcaggggtgtccctgcagacggcttccaaggcagcgcagtgtcatcagttcctccttcggaaaatatccataatgtgacagcactgcatacagtgccggagcagcatggcctttgctgagaataaaacggtcacggcaggaatcttcgggattccccggatcatggcgcatgaccgccccatacagacacgtcaatatctctactgccgacagactgccgccgctgtgtccgcttcctgcacgatgtatcattgtaacaatatccctgcgtatttgctctgcatccatttccagattcgctgtcatatagtttccactcccctttcttcccccacctactcaatcggcggcttcacataatccggcatcatacactcatagctgcgaccctccatggatgctgaaaattctacttttgctttatgtatgatatccggctgggtcagaaggcgcagaaccgccagggcagtgactctggccccataaagcattcccttaaacccgatggaatttcccacacaggcagccacctgccagctatgtcccggtgcggcaatattgtagcaggccgtcttataaaaagtggtcggtacaatatgtcccacgtcccctacatccgtagaaccataatcatcctgtgtatcaatgggcataacaccggaataaatatgggtgtttttgtcctgtgctcctgaaaatcttacgctgtccttccaaatatcaggcacagttgcgtttatcctgcctgcgtattcaatttccgcctccgtccaggcatcctgaggtatggagcgcatgcagtcatccaccagatcccccagcacatggttcggcagtgtgggatagcagccgcccagttcctctattgtcagttcagtctcagtcatcatggcagctcccctggcaaccttttccatacgtttttcaacttccttcattgtttcacgattaagagccctgtcataataccacacggtcgcttcatctggtacaatattgggagcgctgcctccattggtggtgacgtagtgcatacgcacatccatcggcacatgttcacgcagatagttgattcctacattcatcagttccactgcatccagggcactgcggcctttctcagggtcacaagcagcatgggccgtccttcccttaaaatggtatttaacagaatgaactccggtgcagacgctgtaggaagccctggtataccgtccgggatgccaggccaatgcacagtccaactcgctgaaggcaccctctctggccatgaatccctttcccgtcagcacctcctctgcagggcagccataaaataccagggttccacctattccctgcttttccatttccttttttgctgccacggcactgcctgccatggataccgccagaaggttatggccacatccatgtccaaatgcctgtccttcaacaggctctttgtggtccacatcgttctggctctgtcccggcagggcgtcatattcccccagaaatccaattacagggctccccttaccatatacagccctgactgccgtcggtattccgcagcatcctatttccaccgcaaaaccgttttcctcaagaaaatcagcacacaaccggctggcatggtactcccggtatggtccctccggattctcccagatagatcggctcatgtcgcacagacgcccttcttgcctccccaattcctgaaacgcaaaatcacctaacattccactgcctcctttacattattttatcatttttatctcattattttatatcttaaaattaccatattattatcatttatgtcaatacgtttttactttttatattattttaaaataatttttcatttatttatatgcaattctcacaacattgcttctgttatcttcaaataaccgttattaattattgtgttttcaaacaccttttattgatatgttattgacatatatttgaaagtattttaaaatagttatcataaaggaggtatctaaaatgaatgatacaattggagtgattggattaggaactatgggaatagggattgcaggccatctgctggatgaaggatgtacggtgaagggatatgatattaacccggaacgcttaagaatcctggcagaaaaaggcggtatacccgcatcttcgccctcacagactgccaaagactgcagtgcgctggtactcatggtctttaatggggaacaggtcatgaatgtcctcttcggagagaatggagccgctgaaagtttaaagcctggcagctgtgtcatcatctgtgcttccgtaggagctccggcctgtgagcaggctgccgagaagctggaacacatgggcattcatctggtagacagccctgtacgcggcacagccctgtcctgcgaaaccggaacactctacctgatggtgggtgcatcagatgaagccttcactgcagccaaaggagtccttgacaccataggaagctgtgtggtccgtgcaggacataaagcaggcatgggacaaaaggcaaaaacatgcatgcaggcatttttcagtctcacgttccagtctacttacgaagtgttggctctgggtacagccatgggcctggaccctgccactgtttacagcattctggacgatacaggcgcctccagcaacattttccgggccacggcacggaatgtagccagccgccagtttaccggcaccggtaacccattatccattctggataaggacatgaaaattgcctgtcagacagcgaatacatgcggtcttcccgttccatccattgcggccacctcggcaaatttcagcaaggccatggaggagcacgggacagacgatgtgtggtctgccattcttcctcttgagaaggcggcaggaattgaagttaaattcgacattccataaagctgcaattcatcataaaataaagaaaatccgaaaacgcgggaatcaaccgcattttcggattttaaagaacctgtactgaattttatcctttttggcactggcaggtggtggaaccatagaaaattctgggctccaaaaccacttttttcacaatgttaaagcgagttccattttcttccagctcccgaacgcgctccaataccatacgggccgcagcaactcctgcgtcagagtaatgggcacccacagaggtgaaatttgccgtgtcctcgttggattgaataattccaaagggcacaacactcaaatcttcgggaacacgtcttccctgggctgttgtttcatcaatgacgcccatggccatggagaaattagaacacaccacggcggtcacctccggctgctctgtaagaatcctgcgggcggcagccactcctccgtcccgtttcaaattaccgggaataatacgtttttcctcaaaagggatgcccaggcttttcatggagtccatgtaccccattcgttcctcataggaacccgacgcctcctgaggcgcattaatcagggcgatttcgcgatgtcccagctttgccagataatgaatagcacagacagttccctggtaattatccaggatgactgaatccactttggaccaggcctcacaccaatgaaccgccaccagaggaagtgccctgaacttctctgccattttcgccagctctgccctggctccctggctggagataacaatacagcccgccagaagcccgtccttgtccaggttcgttaaatacgtttccagatagacagctttttctcccgtttcacacacaatgggaagataattttcaccccgcaaataattagccgccgcctgaataatgcagttggcgctttgggtaatatcctcaatcatgactgcaatgtaacgggattcctttttgtccatcagcttttccactttctttgagcggtatcccaattcctgcattgcattcagtacggtttccctcgtcttctcattgacactggagtgattcgctaacacgcgggataccgtaactggtgaaacgttgcatttttctgctaccatttttatggtaactttcattctgtttttattctccttttcacgacctttggcccattgggccacgctatatcttattattatatcaaacattcacggtttgacaagttgttttcaatttaccacaggaggtactatcaatgaaatcaggaatctgtctcttacttctggccaccaatcatgaccctctggcccgggccgccataccaaccgctgcaaaagccggttacgattatgccgaggtctccctggcccggatttactctctctcagacaaccagctgtcagattaccgcagtctctttttacaatccggcttgcctgtagaggtttttaacaatgctgtccctaagggactggctttggccggccccggcgccgacccccaggctttgtcacgctacattgaccgagccctttacctggccggtttcatgggtgtctccatgattaccatgagcggtcctaaccgtctcacagtgccttcagaccagacatggatggatatttttccttcctacatacagttccttaaagaatatacagacagagcggcagaatatggtgtctcccttgtaatagaacccatcaatgaagaggagcatagtttcatctccactgtttccactgcaatggatgctgtcatggccgttaaccgtcccaaccttatgaccatgattgattcttaccatttcaccaagcaaaaggatgacccggacacagtcatccgaaacatatcccatatcggacatatccactatgctgcccaggccaggcgctcttatccccttgaatctgatatggatgactgccgtcagctgcttactcccctttttgatgccggatataaaggccgtatcagcattgaagcttacgctgataatccagagcaggatttgccgcaaagcgccaggctgttaggggaaatcctccccaaataagggcggtacttaccggctctcattcattacatatccaaagcgtccggtgtctctcccccaccaagagaagagacatccgcggcttaaatcaatgctcagacaaagggccgcatatcaagaagataccaagataatgtggcccttttcatctattggcataccggtcccggcatgccgtttttctttttctttttcttctgattggatataaatgattcagacgcggtgataccctctccgcagacagtgtccagttcacccgccccatccctttcgcaggcggatacacctgcctctttatatcttttaaccccaatctctaaccatcaagaaatcatatcatgcgctggttcttgatttatagctgtccaacaccgctgcaaacagggtgattcccccagtaaacaccagctgccagaatgaattgattccattgctgttcagtccgttccttatcattgacaccaggaacactccgataaatgtaccaatcaggcctccctgtccgccctttaagctggttccgccaattacagccgccgccacacattccatatgcagcaggtcagccgtccccgacctggcagcccccatgcgtgacatgagcatcatggatgccactgccgccgacatggccgcaattacataaacagatattttaatccacttcacgttgattcccatgacacctgccgccacaggattacttccgcatgcatagacccgtcttccgtatgccgtatatttaagcacgtagattcccaaaagcacaataagaaccgcaatccatgtaaggttggataatccaagggtctttgtccatgcaaatgctgtataatctctgggaagtcctgtcacagtctcctgctttgtataataagccaccactccgcgcaccacatagccggtggcaatggttccaataaaaggcggaagacctatgaccacaacgaacagtccattgcacaatcctatgaccagggcagctcccagcatgatccccatggaagccgggatactcccccctgccgccagatacagcgttgccaccacactggaaaaggccacctgggaccctacagacatatcgtttgcaccgctgaccagcacaaaggtgattcccactgcacagaccaggtaataggctgactgctcaaatacgttcaccatgtttcggaccgtaagaaaatcaggattaatcactgcaaacaggataaaaatgcacaggattgccagatacaggccgcaattgagcattatcttctgccatgtgatatggccgcggaagtttactgatatatttcgttccatatgctacctccagtacagggcctgtctccgtcatcggcggcaggcccgcctcatgcccgtctactctgcaggcattgcccacaaaagcccctgctgcttcagatattccagattctgacgcaccacaatggttgttggcagcttactgtttacccccatagacgatgtatcgccattaaagtaatcctggcaaagtgaaagaatgtcataacagaacaggtcaaaacgctgatttgccacgatgtcattttcaccggcctgaatgcctttcaaaacgctggaaataccgtctacactggcaacaatgacatgacggggatcgtccaccggatacagcctgtccatttccttcagagcagacacaacaggagccacctggttatcacctaccacaaaaatcgccttaatatcagggttggtcttaaatccatccagcactgcattgtaaactttttctatgttggattccacacttggttctccgatcaccttcagatgcggccaatatgccaattcctcattcagacccgacatacgatcgcggactgcggatgaagtcatgtttcccacacatttgaggatttccacagatccctcctctgcatcgtttccattttcatccttcagtgtcagcatggcaatggctttcgccacatcacgtccgcaggacacattatccgtttccagagtataatagatatctgtattgatgcgccggtcaacggcaataaccgggattccctgggccatgatgctgtccacaaccggcgcaatgccatccgggtccacagaattcacgatgatgatatcacagttctgattggcaaggtcctgaagctggtctatctgacgctccagattgttttcagcctgcagcagaatgatttcatcaattccatattccttgtaatggtcctgataattctgaatcaatacctgtgtcgcctccgcagccagactggaccagcagattcccaccacattctttccgtcgtccagatttggattcttagccattccctgcttggcagagccgcctccgtctactgctgcaggagctgcctgcttggtacatcccgctgttcctgccaggagcatggtacctgccatcaccagtgccatccgtctcatccattttgtcttcatacttttcctcctctacattatctcgttttcatttgcttcttccaaacgcatttcccgttccctgcgttcttcatgctttttcaacaaatccatacatacggtaaacagaactacaattccccagaacacgttgtacagatatatggatacattaaacagtctgagcaactggtcaatagatgcaatgaccgccacgcccatcaatgtacctatgatatttccactgccgcccaacatactggtaccgcctaccaccacagcagcaatacaggaaaattccatctgcgctcccatgccaaactgcgctccgccgatacgtgatacattgaccgtacctgccagcccgcaaagtgcccccgtaatcacaaaagtcatctgccgaatcaagaatacattaatgcctgaagcctgaagtgcatctgcattgtttccgattgcatacacataccggccaaattttgtatgattcatcagaacaacccccatggcaaacagaaacagaaatattactacacttatgggtatgttgaatatacggctctgacccaggttggaaaatgcatcgggcatggttatgaccgaatcctttcctatcatgattgacgccgcgccattacagacctgctgcatggccagggtggcaatcatggacggaagtcccagcttggcaattacaaaaccgttgacagaactgaccagcatacaaataaccactgcgcacagcgctccaagcagcatgttctccgtcatctggtatatacgcaccacaataattcctcccagataaacctgggcaccaacggaaatatccgtcacgcctgtcataatcagcatagtcatgccgatagccactactccccatacagcagcctggcttcccagagacagcaggttcgccacactaaagaacaccggcattttaatcagtacaaagattgcaaggcatccaatcagaatgggagtagcatgtttaaatacaacacttcttatgcggtttatacctttcacacagccacctcccttcctcccaggcagagtcctaccaattcttccgaatccacctcatcatgggcgaattcccctaaaatttttccatcccgcatcaccagtacccggtggcacatgccaagtatttccgcttcctcgcaggatatcataataacggataaacccttcttcaccatttccacaatcagttcataaatttcggccttggcacccacatccacgcctcgggtaggctcgtccagaatcaggattttagagtctgtcatgaaccatttggacagtactaccttctgttggttgccgcctgacaaggtgcttacacgctgtttgggtcctgttgccttaataaggaatttccgaaaggcatcctttaccagttccagttctttatgctgttttacaaacccaattcccggaaccgtaatccgtttaagtatggggaaggtcagattcttcttaatgtccatcttcataatcagcccctcttccctacggttttccgtcaggaagctaagtccgtgcttcatggctgttcttgatgaagtaatctttaccgccttaccttctaacacaatctctccggccgcaatatggtccaatccaaaaatcgcccttgctgtctcggatcggcccgctcccaccaggccgaaaagacctaatatctctccccttctcacatcaaatgatactcctgccagtttcttattaaccagaccttttacttccatcactttctctgcatcagggccgggggcaggcggcagctccggaaaatattgttccagcttacggccgattatcaggcttaccagttcctcattggtagcagtagcggtatccagcgtccctacattttcaccgtttcgcaatacggtcacacggtcacatattttaaagatttcatctgatttatgggaaatataaatgatgcaggcacccttttccttcagcttatttatgatgccaaaaaggatttccgtctccctgttggtcagcgacgaggtaggctcatcgaatatcagtattttggcattcagggacaatgcctttgctatctctacctgctgttgttccgctatgctgagctcccccagcctggtggcaggctccaccttaagtcccaccatttccagccattttctggcggactcatttttctttttatcgtccaccaaatgaaagactcccttggtcggaaggttggaaatcataatattttcagccacgctcctcaaatcaaacagtttcagctcctgatgtatgaatccgattcctgcccgttccgccgccttgctgtctgtaattgacacctccctgccatcaatcagtatgcggcctgaatccttggcgtacaggcctcccagtacattcatcagtgtggatttgccggctccgtttcctcccagcagcccgtggacctcgccggcagccacagagagatttacccccttaagcacctcgacgccaaaaaaacttttatgtatatcttctatcacaagataatcgttcttttccatgttatcccttcctctctaaaggatgacttggacaacctctcccggaggaagggcctgaacatccagatcattccactgcgtatcctcggcaaaactacagataatggatacttccggttccaaaggcatgggagtccagtgccagacccctttttccacaaccacggcctgtttttccgtaatcagaaatgcttccattttctcataatcaggcgtgtctgcaccgtccactattttattgggacaaaacacaataacaattggccctgtcaggggagtcataaactcttctgttttaaaatggcgttccatgttcacggttcggaaagggcgtttgaagaacgtggatacaccgatttgaaacacaccgctgtcgcagcggtaaaggcagagcttgggccagaaattaaagcggtctgtgggacggtccggatttccgtcagtcggaatacacacagcgctgccatagggagcaaatccttcttttgtaagctcccttgctttgatcgtcagtacactcatatatttatccccgcttttcaaatttttccaatacggaccgccggattttacacagacagctcatctcatttccaacctgcacctgacctgccagattgagcagcatataaccatcgcactgggcaattccgtaatctgcttccatcctgcgaactaaatccgtatatcccatcttcatggccatactcagatccgcacagttcggcagtccgatggagccaataaactcatcgctgttaatctgagggcatccgaaatatcctgcttcttttctcgaaaccaatgtaatcctggcctcaatcctgccccggcactccagtgcgcatcctgttatctcgccatcaccctggcatgcgtgaacatcgcccatcagcagaagtccgccctccacgttcacaggcagcaccacctgcgcccccggcttcacatcacaaatatctatattaccgcaccattcactgccctgataaaaggaagccctgcggtcatatttaggagccactcctatggatcccacaaacggattcataggtattcttaagcatttgcctttttcctctgttcccatgaccaccatgccatcctcaaaacagcagattctggtcttagctgtaagcggctcctgaaacgtcccgttgatatcctccagcacacctactccactctgaatggaggtataaccttctccgctctcaggtcccggggtaacgcttaaaatgtccactaccagacagtctccctcccctgcgccttctatgtaaaccggtcctgtcacgggattgcagcctcctgccgcttcatagatatcctggaaacggggccacacatcctcgtcttttgcaataagcccgcagttggcatcttcagtctcaaataccaccacatcaccagactggattataacagccggttccgttttcttgtcatagcagaactttttatgttccatgcccagcttataaaccttgctcaccctgattcaccccttttttcatttaagtctgtatttttccagcagtttcctgtcaatgcggcagacacagcttcctgagttgccaatcctgaccttgcctgccagattaagtatcatataaccatcgcagacaggtattccatattcccgttccattcgtttggccagctctacgtagccatttaccatggcagtactgagacggcctctattggcaatagatatcacgccgatccactctttgttatccacctggggccaattcagatatgtggactcttttcccggaatcacccgcacagtggcctcgatgattccctgacattccattgcgcagcccgttatctcaccgtccccctgcatgccgtggacatctcccatggacagcagcgccccctccacatgtacaggcagcagcaccgtggatccagctttcacatccggacaatccacattgccgcaccactcttttcctttataaaaagatgcacgcctgtcatatttgggtgccactccaatggtgcctacaaagggattaagaggaattgttatgtattcttcgttattgtccagtttgtagataacctgcccgtcttcaatcctcaaaatccgtgtcctggcctccaacggtttttgaattgtaccgttgatatcctccaaggctcccacaccgctctggatggatgtataacctccaccccgggcgaatcctggcaccactcggtttatagtgactgccaggctgtctccgggcttagctccatttacgtaaatagggcctgttaccggattgcatccgcctgcggtttcataaatcaccttgaactccggccacaggtctgtctcttttgtaatcagactacagttagcatcctctgtctcaaggaccaccgaatcgcctgattcaatggaagctgcaggctccatctctttgtcaaaagcaaacttcctgtgttccatgcccagtttgactgttttactcacattctctacctcccatctgttccgctatgttatgattgattctctttataccgttttagtacatcccttctgattttgcacaggcagctggacgaatttcccacctttacttcccccatcagattcagcagctgatagctgtccaactgatccatgccatattccttctccatcctgcgaatcaattccgtataaccagtttttactgcttctgataaattgcggtagcccagacatgcaattgcccccatccattcgtctgtattcacctggggccagtcgcagtaaaaggcttcctctgatgatattacggaaatacgtacctccacgattccctggcattcgagagcgcatccggttatttccccatccccctgcagtgcatggatatcgccgattgaaaacatggctccctccacatgcacaggaagtataaccgtggtaccttccgtaatatcgcctatatccacattaccgcaccaatcctgtccctgataaaacgaagaccttcggtcctccttcggcgctacacctatggttcccacaaagggacgtaccggaagtttcaaatattcatcgctttcatgaagtttaaaatgaataccatcctcttcaatagggcaaatcttggtgcgcggttctaaagggggctgcaaagaccctttgcaatcctgaagcattcccagtccggaatagatggaggtatatcctccttttctgataaatcccggaaccacacgtaatatatctaccgacaaacagtctcctggtttggccccctccacataaaccggtccggtcacaggattacatccgcctcctttatcgtacagcttcggaaactccgcccagatatcgctctcctttgtaatcagactcacattagcatcctctgtctcaaatatgacccggtcaccggaatggatggctgccactggctctatattgcggtcaaaggcaaattttttatgttccattcctattaccagtgtatccttcattttctacccctttcctctttgtgtaatccaaaatgataataattagatatatttatgttatatttaagataacatttatcatattatatgtcaacagtttttatttatattttcacctttttttgtgcatattaacattggtttcttgttgctccccgcatataaacagcattttgttgtgattttttagaattgtttcgtgataacgatatgatctcttgtgatatcttttaatgttctgcaacctgacatccgcatggcattctgaagctcccaaataattttctgcgtatacagttctacgcctctggcttccattccctcagccacaataatatatggacgtccaatcagacatgcatccgcacccagagccagcatcttatagacatcttcaccatggcggattccgccgtcaataatcagcttcagcttatcccccactgcctcctttatttcctgaagtacctccactgtagccatggactgatccatggtattccctgcgtgattggaaatgacaattccccacgctcctgcttcaagggctttcagtgctcctcttgccgtcataataccttttaatataaaaggcttatctgtgatggagaatatttcctttaactgtcccgctgatttcggatatgtctttgccttaccattcacggatagataggccagccccacgcagtcaacatcatgaccaatagccatgaccccagcatcttctgccatacgtatcttttccttgatcacttccggttcccatgatttgattgccggaatccccacgccgccgtgttcctttaggcagcgcagcggttcagaatacgctccctctcccatagtgtcaggcgtccatccaaaacatcctgccctttccatcccttccagcaatgcctgggtaaactcataatccccggcaaaatgggttgaagggttaaaactggacacatgaccgtaggctcctgacatgacgggcgctctgaacctgtggcccagccactcaagagaggtgtctatctccgtcccatcgccgccttcatatatggtgtcgtaacggattttaatctgctgcagcttctcatagttgcggattgcagaccctgacctctctgttggaatcatcttgcagttcaggctgttgcataccttacacactctgcatttaggactcatatatggcctggcattctgataaacctcctctaattcagccagaacctccttataattcattgtactcgctggttgcttgttcatctttccctgctcctttcgattgagatattattttatatccttttcgttttttatcatataatattatcatttttatttcaatactaatatttaactaaatttataaaccccccttatgcacattgctttattgtaactattcaccactattttttattttaaatatttgttttagttaattttaacatgtttttctattgacattctacttttttattgataatatttatgacataaattatctttttatatcacaacgaaaggtggtactattatgtcaattcatcagattaaagttcagcctcttacccagaaggccttctctcagtacggtacctgcattgatttaccggctgaaggagattatgagctgagaagctccgaccgcttcgatttttatccaaaattatgcacttacacctgtgattccaatgtctttcagattggtatttccactctgtatgaaagaccttttcgcacagtcaatatggaacgccactatcatacccaagagctgatggtccccttaactaatccaattattatcgtgttttctaaaaacaaggggatggattattcagaagaaccggatatagagacagccgaggcattcctgattacgccgcagcagggggttgtcgtggatacaggagtctggcactggacccccatgccggtaggcggcgactcacgcataatctgcagctttgctgaaaacacatccgccactgatgtagatgtccgtaaattcccggccggagaagtgctggaagttctgctgggctaatggagggcctttgtatgtcaagactatttaaaatcggcgccaccgctgccatgggagcccctgacggttcccccttccccatttcagttaccgattatacgcagactgcagattggcttaaatataacggttttgataccatggaggtccatatccgcgctccccaaatgatcgacggtccaaagctccaggagcattgcctgcggatcggcatggagatatcatccataggcacagggatggcttatggcatggagggtctgagcctgaccagttctgacgaacagatacgccgcagggccgttacacgtttaaaagatcagctggatttaggccggatacttgcatgccctgtcatcatcggttccatgcgcggcctgattgaaacaggagaaactttcagcctcataaacaagaggatgacagatgccatgaaggagctggcagaatacgccgaaaaaacagatggagaactggtcattgaggccattgaccgatttgaaacaaattatctgcgcactgcccaggatgtactggaactaatagaagatgtgggtagtaccagagtcaaggtgcatctggatacatttcacatgaatctggaagagcaggactggcgcagggccatactcagctgtaagggcagacttggacacgtacatgtggccgacaacagccgcaactatcccggatggggattgatagatttccgtcagattatgtctctgctcttggaaatcggttatgaccgcagccttacattggaatgttttcctgtaccggacggggaaactgcactgcgccggggcttaaagcaccttgacgggctcatggaagccatgtcctgcagcatgtagcccggccagattgggagataaaacatgagtacatatatgaagggaatctgctgcacacttctatccgcagtcatctttggctttactccgattctcgtacgcattgcatatgaaggcggcgccaacagtatcaccattacttttttgcgggcctggctggcgctccctctcctgtatgctcttatgcaccggcgtcatatccccctaaggcttgaggattcccaggtaaagcacgtcctgcttctgggcatcgtgggttcctgcgcaactactgtctgcctgtatatgtcctataattttatatcagtgggaatggcgactaccctgcattttatttatcccatattggtaagtctcggctgtgtgctctttttccgccagcgcctgcagactttccagctgttctcactgattttgggatgtattggaatcagtactttcatggacctgagctttggaggaagttttgccggaatagcgcttgccctgatatcgggatttttttatgcctttcacatatcctatatttcggcttccggattacaggatatgtattttttcaaactgtccttttacctctgcctgattacaggaactatatgcggcctgattggcaccctgacagggactttgtcctttcatttaacctggactgcctggggatttgcggttatcgtatccttttttgtttccgtaggcgctatctccctgctgcagttgggtatccgcatgaccggaccgtgtacagcttcaattttatccactttggaaccaattaccagtgtacttctgggggttataatattagatgagaaactgaccttttacaaaggaattggatgtatcttgattctggcaagtgtgattgtaattacactgggggagaacaggaaccaccaccggacagtctgtcaatctatatcagaagaatgatctttaacaacggaccgccagatacatatccagcaccattgcaaacagggcaggattcataagaatcctgccctgtcatgtatcattttttattatccgattataaataatatctaaacttccccgaaattcttaagccccttccctgcgctcccccgcacctctgtcatggagcacaaagtggttcttctgaaaatccagtatcccctcagcccgcatcttactcagctcgctggacatagcgctccggtccacacagagatactcagccagctcctggcggttatggggtatgtcaaaatccctgcccccttttgccatggcctgctctgacagataggacaaaagcttttccctggtggtcctgcggcacacatgctccagtttgttttccagcttcacattgtgctccgacaccagacgcagcatgttgtgtatgaacctggtatggaaatcgcaggccagaggacaaaatgtgatcatccgctggtaattgaggaacagggtctcgcatcccccctctgccaccacgctcaccggcagcaccggggtcctggcgcaggaataggactggccaaagagctccccttcctttatatgatatatgtgttcctgatgtccccagaaattctcctggataacgcatgcctttcccctcagcagaaccagcaccttattgacggattctcccatgcggaaaatgtattccccatcctcataaagcacctgctccgaggcacagcattttaacagggtatagagctcgtcatcatttatgccataaaatagcggagattttttcacaagaggcagccattcctccatattcgcccttctttccgttgcatttacaactcttttgctgtaaatattatataatcaagagatttttccgtcaagagggattttctgtgagataaaatctcatttagcatcaccggacatcatccatttccagctgttttttatatatcccaatgacttttttcatggcctcctggccgggagcccctatggtaaggcgcttctccacacaggtcttcatgctgatggcctcatatacgtcctcctcaaacaccggactgatggccttgtattcttccaggctgagatcatccagggcaattcctttggcaatgcaagcaaggaccagctgtcccacgatgccgtgggcatccctgaaaggcactcccttattcaccagataatccgccgcatctgtggcattggtaaagccgttctttgcactggcctccattacctctttccgaaagctcatagaggaaatcatgccggtaaacaaggccaggcatccctttactgtgtcaatggcgtcaaaggtaagctccttatcttcctgcatatccttattgtaagccagaggtatccccttcatggtggtcagcatggacaccagggcgccatatacgcgcccgcttttgccgcggattagttctgcgatgtccgggttctttttctgaggcatgatggaacttcctgtgctgtaagaatcatcaatctccacaaaacggtattcgttggtattccatattatgatttcctcgcagaacctggacaaatgcatggagatagtggacagggcgctgagcagctcaatcaggtaatccctgtcagccactgaatccatggaattaagggtaggtccgtcaaatcccagaagctctgccgtgtattcccggtccagaggataggtggtgcctgccagggcgcctgaacccagagggcagtaattcatacgcctgcgtatatccttaaggcgggatcggtccctggaaaacatctcgaagtaagcgcccatatgatgggccagggtgattggctgtgccttctgaagatgggtgaaaccaggcatgaaggtgtctgtattcttctccataaccgccagcagctcttccagcagttccttcaccagcgcttcaatggcgtcaatctcatccctggtatagagcttcatgtccagggctacctgatcattgcggctgcgtcctgtgtgaaggcgttttcccgcctccccaatccgctctgtcagggtaccctctacaaaggagtggatatcctcatatccggaatcggatgatataaccaatttcccattatccaggtcttctaaaatgctttccaacccgcggataatatcatccctgtcctgttctgtgagaattccctgcttggccagcattttcacatgggctatgctgcccctgatgtcctgacggtagaatttctggtcaaaggaaagggattcgttaaaattgtgtaccagctgattggtctctttcgtaaaacgtccgccccataatttcatggctcttatctccttatttctaaatttcttttatcctgtattcttgtttgctgcggctttcctggtctgctgcggctttcctggcctgctgcggctttcctggcctgctgcggctttcctgtctgctgcagctttcctggcctgctgcggctttcctatttaccgctgctttcctgtttgctgctattttcttttttctggctctttttgttctctttgctgttctttcttatgctgtatccgcttactgcacggtcctttttcttcttccggctgattcccaccagtacagtgactcccaggacagccgcgctgactccggtaatccaggccccggtcctaagtccctccggttcataggaaaagctgattcggtgggtcccttcaccgatgtccactgccagaaacgtgtcaaacattttccgcggggtcacggccttgccgtccaccagtatggtccatcccttatcataaggaatgctggtatacataacgcctgccgtatctgcggtgatactgcctgacaattccgtatccgtccacctggaaagcaccatgggattctggttcatttttccgtaaacagcctccagggcctggggattaaaacgccacacctctgcctgcagggtcgggctgccgtcatctcctgtctccaggcgcacctccacatccttgttgatacggcccagctctatgaagtagcccctgtccacattatcaaagctctcggtctgctctccgattacagctgtgacctcctttaccttcttattggtcacatacacatagtaatcgccggtttcctgggctgtaaatgtaagtttcctgccctctgtcacactttcgttgggaagcagtacatgctctgtatccagcacatcgcagagatcgttctggacatgggccggattcccggaatccaaaatccagtttccttccacatccgacggcagcataaatgccacgggcagggtaaatttattctcatacagccacatacttccttttctggcggacaaatccctaagtccatcggcaggctgctggtccccgtatatgccataacgcacggacatcaggctgtccaccagaggcgtgcttcctgtgatgctgtaggcattggtggagctttcacaccccatcctgcggaagaaatccgacagggaggcattggctgtggatgaaaacagggatacggacgggaaattcatccaggcgccgtcattctttgtctttctgtctgtcttttccacacgatagaatgtatccgacttaatattccacaccagatcctccacgtcctggttatctttcacataagaagttctgctggtggtagggatgctggttaccgcggtattcacagccgcctcaatggcaaccacagccagagcagtgagaagaatggcgtccagactccattttcccttgtggtacaggtaaatcagacctccatatatggcaatgaacaggagcgccgcatagaacacggaaaaatggtattgttccggattatccaccagcttctctgccagcagcacaaaggaaacagccccccaaaacgccaggcataccgatttccaggacatatcctccagatgaatataggcgtggtaacacatatacagcatcagagcaatataaataaaggactgacggcagggaaggctgttgggatagtggaacccatgccagataaaattcagcacattgactgaaaagctggcgtaaaacagaaccagcatggagcagtacactgccttttccctgaaagtaatcttcctgctgcccaggtataaaaggaagaacataagcactgccacaccgcagtatatattgggccagtggtccaatcctatctcggttcccacatttcctatatgacgggcaatcatatcaaagatggagaaataggatgaaaaggttttagggaaatcaaaatcccctgacgccgtgacctgcagcgcataaatctccggcaaaagcaccaccgcggcaagaccgcctgccagaagggaatagaaggcaaaccgcagccctgttcccatgaactccccaaagcttttgggcggattgagcgtcatctgagcaatcacatagataaccatgaaaatgcaaatcatgatggaaatatagtaattggaaaggatggagagacccagcgtaatgcagtaaagcgtccccttcttctcctttaccagctgctccagccccaacagaatcaatggaaacagcatgatgcagtccagccacatgatgttccagctgtaagcagccatataaccgctaagggcataaaaaataccaaaaaagcccacgccgaacttcttaactccaaagtgtttcttcagataccacgaaaagctaaggccggacaatcctgtcttgagaacaatgagtatggtcataaactcaatgataaacttcttcgggcataatatcagaagccagttcacagggctggccagataataggcatagagcgcagaaaaattcacccccatgccgatatcccagctgtaaagcaggcttcccccatgggtcagcttatactggaactctgaaaaaaacggggcatactgatggtacatatccgtcctgagaaaacactcttccccaaatggaaagatacctctctgggcaaatatgattatcatggccaccacagggacaaaaaatgctgccacaagaccatccgaaggctttagcagccgaagtccgcgcctgttttctgtccgtgacatccctgtctctctcttatcgtactgctgcctgtcctgtccggcagtctcattctcttcttccattccgtattcgtcttcctctgatgtatattcgtctgctgcatatctatccgctatataactatctgcggcatatttatccgctacatacttatctgccgcatatttatccgccgcatattcatctgcggcatatttatccgctgtatacttatccgctgcatacttatccgccgcatatttatctaccgcacatttatctgccgcatatttatctgcggcatatttatccgccgcatcatattccgaagcattttcctctgatgtatcttcaccgaaaagatacgcctccagtgtgctttcttccgttaaatattcctctgatgtcgttttatccccgccggaagccggctcctttgagagcgcttcctcccgggctttatcctgtatggtcggttctggctgcacaagcttcaggattgcgtcaagctcccgttcaacccgttctatctcttcacgttccatcacagtcacctttctctattcaggcttattcttgaatatccagagtttgctgaaaatatagttcagtaccatgttgattacagaggatgtgaatttgcagaacagctcatacagcattcccctgtcgccgcctaatttcaccatgaccaccatgagcacccaggtaacggctcctgagaacgcccgtgcagccacaaatgcccccacctccttcacaaggtaggaaggccgcagattataattgcggaacacaataagcttgttcaccacataggcaaacagcacagccgccagccatgacatggcctgggacaggcctacgcctatctcaatctgcctcagcagggcatataccgcaaaatccactgccgtggtgagaaacccgcatataatgtagcttacagtctcgtagttaacacatttttcccatagtttacgtaacattttctgctcctgccctgttccagagtgcgcgcccacaagccctggagcaataatcccttctattatatggtagcatcatggaattgtaaagaaaaaaccattatctgtacaggaaatcctcggctcccctggtgtaatggagttccccgtcttccgtaaggaatatgccgtagatttggtccatggattctatgagcctggtcccctcttccaatcccagggcaaaacaggtggtgctcagtccgtccccgtccactgacctgggggaaatgatggagacctgggtcagcccattttcatatgggtagccggtagccggatccagtatatgatgatagttgacgccgttctccacaaaatgcctctcgtacacccctgaggaaaccactgacatatcgtctattttcagcgctgccactgtctctgtatgggttgcgtacggcctctggagccctattttaaaaggagagccgtccggccgttttcccacgcagagcacatttcctcccagattgatgaccgcacttttcacaccgttttcttccagatatgccttcatctggtctgctataaaccccttggctatggcgcccaggtcaatggttgtctcatcattgagaaaggtgacctgtctgccgtccagaagcacattttcatagcccacctttttaaggtccgcctcaatttcctcctcaggcggcacatggggcgtctttcctgtaaaatcccacagggaacttaagggctctatggttatatcaaaggccccccgggacatacggcagtactccagcccctccgccagaacctgggctgttttctccgatactgtgatggtcctctcgcccggcctgcggtggttcagtttgtaaatctcgctgccctccagggtcttgctgagcagcttctcatagtcggaacagagtgtcatgcagccgtccagaatggtctggtcctctgaatcgtataaggtgacggtgacaaatgtgttcaacaaaaaagacgacctggtgacaggatccgcaaccttcttgctgcatcctgccagccaagccgtgcacatgataatcaaacctgctgttattattgtctttaatcctgtatttttcatgccttacattctagcacccgggcatgtaaaagtcaaggcagccccatcaggctttggtctcttccatgtactcatccatcacagcgtccagaatatttttaagtgtctctggcgccctgcctcccaccggcgtgccgtcaatctcattggcagccacacacagtttggtggatgatgtcaccagaacctcatccgcatccatcatctccttcagggtatagggagtctcgcttacgggaatctccagtttcttacaaatacgaatcaggtgggcccttgcaatacccggaagaatcagattgtccgcaggagccgtgtagagaattccatccttcaggatatggcagttgctatgggcacattccgtcacacggtcgcctctgtggaacaccgcttcctggcatcctgcttcctttgctttctgggcagccatgacactgggcagcagattcagggttttgatgttgcagtgaaggaaacgggtgtcctcctgggtaagcaggcgaatcttcttgtacaggtccggtgttcccatgggctttaacataacccagagattggccggtacgttctccggaaattcatgggttctgacagcggtacccctggttacctggaaataaataaacagatctccggtatccatcttattgaccaattcctgaagcagcgccttcagctctgcctttgtgcacggcacctgcatcttaataaggcctgcgctgttgaagaagcggtcaacgtgctcgtcaattgcaaaaatcttgtaattgcggcagggacctgcatcgtatacgccgtctccaaaccagcataccctgtcattcatgggaacactcatgttctccagttcgtcgtactttccattataatatccaagcgttttcatatatgtaatctcctttataataaaatattcattgaaacatgatgctaaaaccgctttttctcttcttccggtatggcggaatacatgtttttgatttccttcagaacgaaatgggtcctggtggcagacacaccgggtatgctcttgatggtgcggtggatgcgctccagctcatcggaggaggcgcaggatatcttcagcacaaagtcataatctccggtcagatagtagcagtccaggatattaggatgatccatgatcacctcggtgaaggagtcatggaacctgggatgttccaggctgatttccattagggctgtgacatcgttccccagggccttggcatccacccttaccgtatagcccttgatgatgccggactcttccatcttcttgatgcggtccagtacggccgatacggacaaatgaatggctttgctgatgtctgaggctgtctcccttccgttctcttttaggatgttcagtatcttatagtcaagtttatccatcttgtccccctgttattttagcttttcaaatgtgatttcgtagtatatactggtaggtggatagaatgcattttctgcactgccctcgccgtgactgcccggtacgcagtgcgccttgccgccgggctatgccctttgtccgggtcacaggcttcgtggacattataacacaaatcatccaggagttgtactatgaatctctcttatttgaaatatgcggtagaagtggaaaaaactgggtccatcactaaggcggctcagaatttttatatgaatcagcctcatctgagtaaaatcatccgtgagctggaacgtgacctgggctgtgacatcttcgacaggaccagccgcgggatggttcccaccaagaagggtgaggagttcctgcgctatgcaaaggcaatcctggtccaggaggaacagattgaggccctgtgcgtgaagaacagcgaaaaagccctggaggtgaatctgtgtgttcccagagccacctatatttcctatgccttctctgattttcttaagcatatggacagctgtccctctgtcaatgtacattacatggaaaccaattccagggacaccatccggggtgtgtcaggcaagacctttgacgtgggcattatacgctgtcaggccctgtatgaatcttattatatgaagcttctccaggatgagaacctggagtggaaggaactgtggcaattttcctgcaatgtccttatgtctcccagccatccccttgcttccagggacaagctgacttacctggattttacagattacattgaaatcgtccagggcgacatccagaatccttcctttacctttgaggcccaggatgcctctgccaccggcggcaactccaagaaaaccgtttccatctatgacaggggaagccagtttgagctgctgcgccagctgcccggttcctatatgtggacctcgcctgtgccttacggctgtctcacctcctcaggtttgattcaaaagacatgcagttatcccggaaacatccacaaggacctgctgatttacaggaacggataccgcttttccaaggaagaggaggagtttctccggtgcctttcacggatggtaagccgtctttccgattgacccgccgggcgcacgtacataaaagcccgtcagccccttcattgagcggctgacgggcttttcgtttactcttaaatcccgtttgttcctatttagtttgttcctatttatatagtgtaatccgttttaccaggacccggagagaatcctcgccagctcactgtcctcgttcagtatgacagtcttattgtcccctttcatggaagccttaagggcatccagggagcgcacataattatagaagtcggcctttgcctcgtcattgtaggcgtcgcttaatatctgcatgtatctggcctcgccctccgccttgatcttttctgcctcagcgttggccttggcaatggtctcctttaccgtcttatccgtctcattcttaatcagggatgactggtaatcgccgtcagccgtatactgggccgcaatgttgtttcgctcggatatcattctctggtacacggattccttgttggaatcaggaagatccagcttctttgtctccaccgcatagatgtggatgccgtaggaatccatggcatcaccgatattctccgtgatggtcttagccaggttcccgtcacggcctgatataatatccgcctggttagtggaggaaagcacgtttttgatggagttatataccacattccccagcctgacctccgccttttccttgctggcgttcagagacgccagatatttcaccggatcattgatatcccatatgacaaaggaatcaacggtcattacctttttatcctttgtggttacatcgcttggatacaggtcggaaatcatcttatacttaggtatcttctgcacggactgcaggaagggaatcctgagggatggtcccgccgaattctctacccggaccacctttccgaactgaataatcagggagtactcgttggattttgtgaccaccagcggattgaaaatggtgacagccaggagcacgataacaatgattcccatgtttctcataaatttagtcaatgtcttcattactgtccacctccgttctggtcattgccctcatataattcctcctggtcataggagccggactggctgccgctgtcggcccctgcctgatttgcccgtcctgtctggtccggctgatttgcctggctgttgtatgaacctgccggagagccggtgctgctctgggttccggaaacaaaggagtccaggggaagcatggtctgtgtcccgtctgatccgtttatgatgaccttaagccccggaaggatatcctccatggtctcatagaacatcctcttctttgtaataagaggatactttgcatattcctggtacatatcgttgaatctggatacctgcccctctgcctcgctgattctctgctggcggtaggcttctgcgtcccttgcagccttgtccgcctctgcattggctgccggaagccgctcggactggtacttcctggcctcgttgattttggtatccatgccctgtttcgcatcctccactgccttaaacgcattgtttacagcgtctgtaggcggctgcgcgtcctggatggtcacattgttaatgcccaggccgatgtcctcctgctccaggcgctcagacagcagtgccttcaccttagcctgaatctcggttttgccggtggtgatgacctcgtccacgctgtaggagcccaccgtatccctgatataggactgggccaggttttttaaaatcggaatggccgtatcgctgtggatatacgccttaatggggtccacaatctgatactcgatgtaaaaatccacatttacaaagttaaaatccttggttatcatctctgactcggacgtaaccgaaattggattgttttcgctgtccgcatggttctgcgcgttgtaatccgggtcatatccaatgggcatgcccttgatttccttggacatcttatgtaccttctgtataaaaggcaccttgaacttgggccccgaggtagtgacgctgcttggacggccgaaggtggtaagcactgccatctcgttctctgacagggtatagaaagaatcaaaggcagcaatggccagaacagccaccacaatggctatctttatggggcggagcatccgcttcatcctcttgttgctttcttccccgttgtcaaatactacttccggtccctgatcttttttaccgcctccaggtcccacgaacttcttacccatgaaaaaattcatccggtattcccctttctcagtcattttagagaagtataccataagtttcacataccggatagcatttctctccagtttccaataattttataattccgttcgggagataccggaaaaggaataccggtattcctttttcatacctacccattccaggtcaaaggtgttaagatgtaatcgttaaagaaataacacaccaaaacaacattttacatatactgggaggtattatcatgagatttacactgccaagagatttgtaccatggaaaagatgcactggaagcccttaagaccctggccggcaaaaaagccattgttgtagtgggcggcggctccatgaaacggtttggttttctggacaaggtaattgattacctgaaggaagccggcatggaggttcaattatttgaaggtgttgagccggatccatctgtggatacagttttaaaaggcgctgctgccatgcaggaatttgaacctgactggattgtggctgtgggcggcggttctcccattgacgcggcaaaggcaatgtgggcattctacgaataccccgacacatcctttgaggatctgattacaccattcagcttcccgacccttcgtaccaaggctaaattctgtgcgatttcctccacatcaggaacagcaactgaggttaccgcattttccgttattactgattataagaaaggcatcaaatatcctctggccgacttcaacatcacccctgatgtggccatcgtggacccggccctggctgagaccatgccaaagaagctgaccgcacacacaggaatggatgccatgacccatgcaattgaggcttatgtctcaacccttcactgcgagtatacggacccgttagcactccatgccatcgagatgattaacgagtatctgataccttcttataacggggatatggaagcccgtgataagatgcacgatgcacagtgtctggccggaatggcgttttccaatgctttgcttggaatcgtgcactccatggctcataagacaggtgctgcatattccggcggtcacattgttcacggttgtgctaatgcaatgtaccttcccaaggttataaaattcaactccaaagaacctgaggccgccgccagatatgcgaaaatcgctaaatttatcaaccttcccggcaccacagatgaggaactgactgatgcccttattgcccgtctcttagagatgaacaaggccctggacatcccggcctgcataaaggattatgaaggcggaatcattgatgagaaggaatttatggataagcttccaaaggttgccgaactggccgtaggcgatgcctgcaccggctccaacccaagaaccatcactcctgaggttatggaacagctgttaaaatgctgctactatgacgaggaagtagatttttaactgcccccttttgtgttacactccatatatacggtttgtttttactgcccgaaaagggtgggaaagaattcgtctttcccacccttttcacattggtattttcacgttgccagaagctgttccatatagcgcagatacccgcacagccctgtaatgatgaatatttccagaaaactggtgataaagcctgcttccaggaggaagaggacggagcaggctgccatcatccacaggatgccccatgccctgcgaaaacgcatccggtcgcgggagctgagaaagcggaggaagccaatgatactgaaggccagaagcacaggcgaaaaaaatgcaagcagcacatggaggtctgccttcaggggatatttctccggcatatagggaatcataaccgccatgagaagaaaggctgccgctgtatacatcagggtcctgcctcccggattcctgtatcttcctatgtgaaaaagataacggacatacacacagtaatagatgccggtggcaaatccccacaccgcaaacagcagcttgttgcctgtgcggttgcccaggacagacaggttggtaccggtccagctgtcaaaggatgccaggaatatggtcacgccgggaatcagataaatcgtgaagaggtcgtattttccttgaaaccgtacattccggccctgcatggtcctgcctcctttatcagatggtccctgctcttaaatctgtcccggatcgcctgctatccgcatatccgggacaatgaggaagggagcgcgcacatctgcttgcgatgcgccgctccctatcattatctgatgaagtgctgacttttacacttgaatcattttcctttgaaggtatctgacctccaattatgccattgtttctaaaagcttttccacagaggagagctttacgcagagtgcaaacagctccgcagccgttatcaaatcccccaatgtgggataggtgggcgcaatgcggatattgctgtcatggggatcctttccgtaaggataggtggctccggcagatgtcataaccactcctgccttcttgcatctggccacaatatcctttgcacacccctccagagaatcaaaggagataaaatatccgccccttggctttgtccaccggccgattcccagtccttccagctcacgctccaatatctcctccactgcctcaaattttggccggatgatgtctgcgtgctttctcatatgctctaccatgccgtggatatccttaaagaaacgggcatggcgcagctggtttaccttatcatggccaatggtctggttctttaactgggccttgatatcctccaggttattgtgggaggtggcaatggccgcaatgccggaccccgggaagctgattttggaggtggaagcaaacttataaaccaggtcaggatttccggccctcttgcactctgccagaatttcaatcaaatgatcctggtcatggtcatacaggtggtgtacgccgtaggcattgtcccagaatatacggaagtcggacgcggccggcttcagccttgcaaaacggcggaccgtctcgtctgaataggaatagccctggggattggagtacttgggtacgcaccagattcccttgatggaatcatcggaagccaccagttcctccaccatatccatatcaggtccgtcctcggacataggtacattgatcatctcgatgccgaagtattctgtgatggcgaaatggcggtcatatccgggaaccgggcagaggaatttcaccttatccagcttgcaccagggagtgcatcccatgattccgtgggtcatggccctggatacggtatcgtacataacattcaggctggaattgccgtaaatgataatggtggaaggattcacctccatcatatccgccagcagtaccttggcctcgtcaattcctgtcagcacaccgtaattgcggcagtctgtaccgtcctcgcaggtcaggtcgctggtgctgctcagtacgtccatcatacccatggaaaggtccagctgctccacacacggctttcccctagacatatccagcttcaggtcctttgcctgaaactcatggtactgtgctttcagatcctggcgcagtgaaagcagttcttcttttgtcatctctgcatatggcttcataatatcctcctggctcactatattttctataaaatgtgtccgtcaggcatacatctgtcagccaccggtcaacattttcgtacattgtacacaagcatacaccaataaaagcattccgtcaatacaaaattttcttatattgtcaaaagatatacttatgcctttttccatctgtctctatcacagcttatacatctccgccggcaagcagctcccttacaagctggttcactatggacggatccgcctttcccttcatagccttcatggtctggcccaccagaaatcccatggccttttccctgccgttcctgtaatcctcaacagactgcggattggcagccatgaccgcctttacggtgtcccgcagggcaccctcatccttcaccaccttaaggccattttcctccacatatgcctcagggtccgcatcgtgcctgaatatctcttcaaacacggttttggcaaccgtcctgttgatgatgttgttttccaccatgcggataagggcagccagatgggagggggagaattccatgtcctccggctccatctcctgttccttcatcaaacgcatggcttccaccataagccagttggatgcctccttgggccggccgctcaagcgggtggtctcctcaaagatgtccgccatgtgcttggaactggtgagaagcctggcatcatactcaggaagcccgtattcctccttgtacctggctattttctccgtgcgcagctccggctggcgggccttaaccctggcaatccactcatcgcttatgaccaccggcaccagatccggatcagggaaatacctgtaatcctgggcatcctccttggatcgcatggccttggagctctccttgttgtcatcccagcgccgcgtctcctggattacctgcctgccctcttccagcagctcaatctgacgcctgcgctccccctctatggctctggcaatggccttaaaggagttcaggttcttcatctcggtcctggtgccaaactcaggggcccccgcctctctcacggacaggttcacgtccgctctcatggatccctcctgcagcttgcagtcagaggctcccaggtactggataatcagcctcagcttctccaggtaggctatgacttcctcggcgctgcgcatatcaggctccgacacaatctcaatcagagggactccgctgcggttgtaatccaccagggaacagtcctcccactcatcatgaatcaacttgcccgcatcctcctccatgtggatttcatggattcccacgcgtttcttaaggccggactccgtctctatgtccacccagccgtcgcggcagacaggcaggtacagctgggatatctggtagttctgcggattatccggataaaaatagttctttctgtcaaatttgcagtactggttaatccggcagttggctgccagccccacagccagcgcatactccaccacctgcttatttaacaccggcagggagcccggcatgccggtgcagacagggcaggtatgggtattgggcgctcccccgaaccgggtggaacagccgcagaaaatcttggttttggtggccagctccacatggacctccaggccgataacggtctcatactgtttactcatggctcctcctctctgccctcccggtcaaggcgccggacggctccttggccttcccggcagccaaaagagacagcttccactcccgtgttttctcgtaagcataggcggcccggatgatatttttttccttaaaacagtcgcctatgagctgcagtccaatgggaagtccctttgaatccaggccgcagggaaggctgattccgggaagaccggccaggttcacggaaatggtatagatatctcccagatacatcttcagaggatcccccagggactggcctaaccgcggggctgttgacggcgctgccggcgccagtatgacgtcataggacgcaaatgcacggtcaaattcctttttaatcagtgccttggtgcggagagccttcagataatatgcgtcatagtagcctgaactcagcacaaaggatcccagcatgatgcgtcgcttcacctccggtccgaatccaagggaccggctctttttgtacatgctgtgaagcccctcgtattccggcgcccggtagccgtactttacaccgtcaaaccgggacaggttggagctggcctccgcagaagcaataacatagtaggcaggtatggcatactctgccagcttaaggtcaaaggtctccacaatggcccccttttctcccaatatcccggctgcttccagcacagcgtccttcacctcctggtccagcccctgcccaaagtaggattccggtatgccgatgcgcattcctctgacatcctctgacagggctgaggtgaaatcacagtccccccgctccatggatgtgctgtccttggggtcatgggaggccaggacctccaaaacagcggcgcagtccgacacgtcctttgccacaggccctatctggtccagggatgaaccataggcaataagcccatatctggacacggtcccgtaggtgggcttgatgcccgtgacgccgcagaaggagctgggctggcgtatggaaccgccggtatcagaccccagggcataaaagcactccccggcagccaccgccgcgcaagaaccgccggaggatccccccggcacatgttccagattccacggattcctggtaacgccaaaggcggaggtctccgtggtgcttcccatggcaaattcatccatgttggtctttcccaggataacggctcctgcctgctccagattggaaactgcctgggccgtgtaggtgggaatgaaatttcccagtatcctggaactgcaggtggtccgcattccctttgtacacatgttgtccttgatggccaccggtactccggccagggggcctttcaaccttcccgcctcaatgtctgcctggaccttcccggcctgttccatggtcttttcttcatttacggttacaaaggcgtggatggatggctccatggcctttatccgcgccagagatgcttctgctgcctgaaccgcagtgatatcccctgactgaattcttcttcccagctccagggctgtcatatctgatatgctcatgttcccattcctcctatcctacggtcttaggcactttgaatgctccgtccttttgctggggggcgttggagagaatctggtccctctggtccgtgcctgtgaccacatcctcccggaacacgttatgcaccggaaaaacgtgggacataggctccacgccctgtgtgtccagttcatttaacttatctatataatccagcatccttcccatgtccttctttgcttcctccttttcctccggggaaagttccagctttgccaggatgcctacatactcgattgtctcgtcacttatgatatttgccatgattcctgctcctctcagtcattttcctgtccctatggctccagcctggtcacatcccttgggaacagtgacgcctccctgacattctgttcatccagaagcctcatggtaaggcgttccagtccaatacccaggccgccgtggggcggcacgccgtatttgaaaatcataagataggaagcaatgtcctccggatccatgccccgcttctccatcttggctgtaatttccctgtaatcatgaatccgctgtccgccggtggtcacctccagcccccgaaacaaaaggtcaaaacttagagtgaatctggggtctgccgggtcgtccatggcatagaagggccgttttttggaagggtaatgtgtgacgaacacaaaatcgcttccatactcttcctggaaataccgtcctatgagcagctcctcctccggctccaaatcgtaggggttgcgtatcttcctgtcatattttcttgaaacaagttcctttgcctggtcaaaccggaccgctggaatccgtcccacctccggcagggtcacacccagcatatccagctccttcttataatcctgctccagaagtttcatcacatactggagcattcccgtttccatatccatcacgtcccggaagctgtcgatataccccatctcgaaatccaggctggtgtattcgttgagatgccgggtggtattatgtttttcagcccggaacacaggcgctgcctcaaacaccctgtcatatacgcccaccatggtctgtttgtaaaactggggactctgtcccagctctgccttcttattaaaatattccagtttaaatacgttggagccgccctctgcccccctggccacgattttaggagtgcgtatctccgtaaaatccctgcttaaaagataatccctaaatccccttacaatgccttcctgaatcttgaatttggcccgctcccgcacgtttcgcagggagatggggcgcagggaaagctttgtctccagggatgtgttcagcttccatttgctgaccgcaagaggcaggggctctgcaggccgggacagcacccggatttcctttaaccgtatctcaaaaccctggggcgcccgttcctcggcctttacaacacccatcacctccacggcgctctcttccttcaactccctgatatcaaaatccgtaatcccggcctcatatacacactgcaccagcccccgggacttgcgcaggatgacgaaggccacctcgcccatatggcgtatggtatgaacagccccgttcatccgtatttccttgccctcatattccccttcaagcacttccctgatatccaggaccctcttctccttaactccgttcacaaattccatggcactctctcctcgctatgagcacttgacatctgtcttttagatgtctagtgcgatgcatgtcactggcacttggcaggcgtattttgactgcctagtgcagtgattcgctatgagcacttgacatctgtcttttagatgtctggtacaaactggatttcggttccggttgattttcttttccatggacataagccggctgtctggtccacaaataaaaaaacgccccggaacacagtaactgcattccgggacgggattcaattcagacatttcccgcggtaccacccgcattgagacctggtcccgcagcaaactgccctgcgcttccagctcccctctctatgtacgtaacgtgtacaacggatatacctactatcagccgtgtcctggccgcttcgatataccagctccagagtgttcccttagcccagtcctgcccggcggcgctctcagtcggtgacgcccccttcctgtcacatttctcaggccagagtctctttcattgctgttgattatttatttactaaaatagtacatcactgattcaaagtcaagggcaaatatttctccgggatgaattttagataatttcacaataaatatgtccatgtctgaatatttattgtaacaattgaaactgtctgccggcattccataaaacggatggaaagcaggtcccggcatgtcatatttttactccgctctgcatagactgcaatatggaaactactatacatataaaggagctcatgatgttatccatccatgattttcattattcctccgatgcaccctatccacccatcaaagcagagtccgggaatccggcctatgcaagggtgatgttggacaacataggcggaagcaattcagagatgtccgccatatccctctatgtcttcaaccaactgattaccggatacaatcccgatgtcagcgccgtattccacaaggtcagcatcgtggaaatgcaccatctggaaatatttggcaagctggcccagcagctgggagaggagccgcggctgtggacccagcacggatgtaagaagatatactggtcccccagctacaaccagtatcccggagatctgcggaccctgatgcgcaatgttatcgacggagaaaaggcagccatcagcaagtaccagcaccagatttcctacatacgggatgaaaatatcaccgaaaacttaaggcgtattattctggatgaacggctgcatgtggaaatttttgaaaaggtctacggaacgtattgttcctgaccgcccttaagcatggcgtatattggtaaattccgatatctccctgctgaccgtgcataaatcatccgcatccatgtcgtgaatgttgtcatgccctgtaatcctggcaaatgtctttatctcctccagggataccctgaggaaattagccactctctgcgcggccgcgtcctccttgaagcggctgcgcagtttctcgtcctgggttgccacccccacgggacacattccggtgccgcatatgcggtactgctggcaggcggctgccatcaaagctgcggaagcaatggccaccgcgtccgctcccatagccagtgcctttgcaaaatcagaggatacccgcaggccgcccgttatcaccagctgggccccgcagcctgcctggtccaggtatttcctggccctgtaaagggcgtaaatcgtgggtacgctggtggaatccctgataatcttggggctggctccggttgcccctcccctgccgtctatggtaataaagtcaggtccggcatagacgcagaattccaaatccttctcaattcttcccgctgcaatctttatgccgatgggccgtccgccggatacgaggcgcagcctgtccaccagggccttcaaatcctctttggtgtcaatgcccggaaagcgcgacggactgataacatcctgtcccaagggtttattccttatggccgcgatctccggcgtcaccttgcctccgggcagatggcctcccatgcccggctttgtgccctgcccgatttttatttcaatggcgtctgcttccctcaggttctcgtctgtcacactgtactggtttggaacatattcaaatatatacttgtaggccgccgccttctcctccggcagtatgccgccctcgccggagcacatggctgtgcgggccatggcgcttcccctggacagcgctgtctttgtttccctggaaagtgctccaaaggacatgtgggaaatataaaccggatggtccagcaccatgggcttggccgcgagttttcctataatggtttctgtttttaccggagcatgttcatcaagcggcatggggttcagctgggcccccagaaacaggatgtcatcccagcttggcatgggcatctgggttcccatggctgcaatgatggactgtccctttacagccatctcatgaatttcgtccatatagcgggcatcggtctgtgtcctggcatactcaggatcataggcagcagcctcccctgtactgccgccgcagtcctggcatgtttcccgggttccgtcttttttaacaggcttctccttttctctgtccggagccttggcaccggcccctccgtcctctgccttcaccagcttatcggctgtgaccatgcacacgggacagacttttaaatcagatacaggaactccctccttctcctcatcataaattgaaccacagaatctgcaacggtatactgccattatgtttcccccttctcttgatcattgtcaataatagtaattattactgttttaaatatagcacaaacaacccacaatgtccagcgttttatgcccctatatgtcattgacttaccataataagtaatgttacaatatcttttatgcacaaacgagaaaggaagtcgcactacatgtcacaagaaaacaaaatgggcgttatgcccattaataagctgcttatatccatgtccctgcccatgattatctccatgctggtgcaggccctgtacaacatcgtggacagcgtgtttgtatccatgataaaccaggctgccctgactgcggtgtccatggcatttcccatccagaacctgctgattgcagtatccgccggaacctgtgtgggcgtcaacgccctgctgtcccgttccctgggagaaaaaaattcaaaggcggccaatctggctgctgccaacggcctgtttttggccttcttaagcttcctggcctttgcagtattcggcctgttcggatccaggctgttctttgaaagccagacaaacaacccggtcatcattgaatacggcgtacaatatctccagattgtctgcattttctgcttcgggctttttggggaaatgatgttcgagcggattctccagtccacgggccagaccttttactgtatgattacacagggcaccggggccatcatcaatattatactggaccccattcttatcttcggcctgtttggagtgccgaaaatgggaatccagggagctgccgcagccactgtattcggccagattgtggccatgttcctggccctcatcctgaaccacaccaaaaacaaggaggtgcggattaatttccgttcgttcacccctaactggagaactatttccattatctaccaggtaggcgttccctcgattatcatgcagtccatcagctctgtcatgacctttgggatgaataaaatcctgattggattttccgagacagccgtagccgtattcggagtatatttcaagcttcaaagctttatcttcatgcctatattcggactgaacaacggcatgatacccattgtggcctacaactacggggcccgcagtaaaaagcgcatcatggaaacggtctggctgagcatcggcattgcagtgggcatcatgctcatcggactgatggtgttccaccttatgacaccccagctgctcatgctcttccaggcagacgaggagatgctggccatcggcgttcccgccctgcggattatcagcctcagcttcctgttcgcaggatactgcatcatcgtgggatccgtgttccaggccctgggcaacggcgtatacagcctgattatatccgtggccagacagcttgtatgtatcctccccctggcctggttttttgcccgaacctttggactgcatgcagtgtggctctccctgcctctggctgaaatcacctctgtggtgctcagctccatcctgttccgcaagatttatctggataagataaagcctctgggacaggcggctgcctgacggatgccggctgctgatttatgtttgactcacccatatacgaaacgggctgtccgggaacagattatattcccgaacagcccgtttgccgtcctgatcttactgcctactctgccgcataattcaatctcaccgtaatattggcagtcttataacgggagctggtgtccaggtacccgtcgtagctgtaggattccgatccggaattctttgccgtaatctggaacacgcccagagtggcgcttaacagctttcccgcctttgcccctgaaccggcagacataatgtcaatgcgctcctttgcattggcagtggccttctcaatcaggtccagcttcacctcgtccagcttggtataataatactccggcagctcagactcgaactccacccctgattcgatcagcttagtgatatctctggagatattctccaccttgtcaatatcataggatgaaaccgtcaggctctgggtcaggtcatatccgtccgtctcatctcccaggtacttgccctcctcatcgtatctggatgtataggtctgggaaatattcacggaactgaatatcatctcatcctccgccacatggttttcctccagatactgtctcaccagttccgcatccttcttgatgatggcgtaggcatccctgggcgtatcgccgtggacagaaaagctgcctctccacacaatcaaatccgactcaaaatcacagctggcagaaccggttgccgtgattccgcttcccccgccgctcttcttataatccaccagtccgcctgtaaagatgctgacgcagataatggcgctgagtgccgcgatgatggcgataatcacagacctggcctgagccatgaagcctgtcttttcttttttctccttgttctcttccaatctctcacaaacctccttttatatacatgttcctgcaaacctgcacgcccggcgcaggatgtggtggttttagtatagcatgtaaaaggcggaagagacctgacggctttcttaatatttacggtcaaaatagcaggaagcagaaaacaggcgctgtatcactcccctatcaggacatccagccgtttcagggcctctatgtatatcaccatggcattggtaaggttttcaatcttcacacactcatccggctggtgaccgccgccgcggcccggagggcagggctttttctgtcctctgatgcccggcccaaaggcgaccgcgttaggcagtttcctggcataggtgccgccgcccatggaataagcctttgtctctgtccccagcacctggcggcacagggcggtcagctcttttaccaccgggctttccggatcaatgacacagggcgggttatcccggctccagtccagaatccatccgtatttcccggcttgtgcgctcatctgctttaccagtgcttccgcgccggcagtcaccggataacggatattaaaattctggatgaaccgtcctctctctgtcctggccatgcctcccaccagggtaagcctgccggacagcccatcctcaaaggcaatgcccataccttccccgtaataatcagcaaatccctggtccaggaaccggaagcaggcctgttcctcctctgtcaggaagggggctttggccagcatatgggccagcttcaccgccgcgctgtcagaaccctcgggaaaggcggcatgtgctgttttcccggcagcctttataacgatctggcttccgccctctacggtaaaatcctgggggttatcaaggctgtccacataatcccggaccgcatcgcagcttgtccggctcagccatacccgtgcctctgccggaaccgcattggacgccactccggccgaaaaaccggtcacatggccctccggtatggcacatgaaaattccccttccaggattcccttttccccgtaacacactggaaatgaggcatccggagtaaaggaaaattccggcgcaggataatgggaggtatagtactcaatgtcctccatcccccgctcttcactgcatcccagatacagccgtatggtgtgttccagcgggactccctgttctttcagatatttcatgctgtagagcgcggcagcggcaggccccttgttgtccgcgcttccccgaccgtacagccaaccgtcctttatcacaggtttgtagggctctgtcgtccatccgtttccctcatgcaccacatccagatggacaaaaatgcctatttcctgtcctgtccggcccggcatgagaatacttccgcatcggtaatcatggttttccgtctcaaagcccatttgcttccctatctccaaagctttgtccaataccatggcgcagccctccccgtagggatgctcccttgttcccggttcgctgacactgcgtattttcatgagctccatggcggtatccagcatattttctctctgggacaatacccattcttttacatccatatctttattttcctctattcatagcagttcagacggcacatcatcctgccgtctgaatttctgcttttattcatcatacagatgacaggccacaaaatgcctgtcccccacatcctttaattccggcacctggacacggcatttttccgttgcataccggcatctggtgtggaacctgcagccctggggcgggttaaaggggcttggcacatccccctccagatggattttgttgtactcaatatccatatccggaatggggatagccgagagaagggcctgggtgtagggatgttttgcgtcttcatacagcgccttcttgtctgctatttccatcacatttcccagatacatgaccatgatccggtcacagatataccgcaccacgctcaggtcatgggaaatgaacaggtaggtcaggtccagctccttctgaagatccatcatcaggtttaacacctgggcccggaccgatacgtccagggctgatacaggctcatcgcacaccacgaatcttgggttgagcaccagggccctggcaataacgattctctgccgctggccgccggagaactcatggggatagcggttcatgaattccagcggaagccccaccttatccataatttcaatcaccctggcttccttttcctcctttgaacccatggcaaatacatccagcggggcgcaaatcagctccctgaccgtcatacgcggattcagcgaggaataggggtcctgaaatataatctggagctccctgcgcatctggcgcatctcttctctgccgtattccgccaggttctttcccctgtaaaccacctgtccctccgtgggttcatgaaggcgcagtatggtcctgcccagagtggacttgccgcagcccgactcccccaccacgcccagggtttccccgtactccatggaaaagctgactccgtccagggcctttaccgcccgcggctccctgcccctgcgcttcttgccggagaaaaagtatttttttaaatttctgacttccagaattgtctcgttgccgctcataccttttcctccttaagattctcatacttccagcagctcaccttgtggccgtcatccgtgatatacaccggcggctggtgctccctgcatttgtccatggcctggaggcacctggcgcagaacctgcatccctttggcatcctgtccagggacggcaccgtaccgtcaatggaaaacaggcggtccaaatccttgtcaaggcgggggatggaggccagaaggccctgtgtataaggatgcatggcctccttgaatatctgtctggcgcttccgtactccatgaccttgcccgcgtacatgaccatgatgtagtcagccatctcagccaccactcccatatcatgggtgataaggataatggaagcattgatgttcttcttcagctccaccatcaggtcgataatctgggcctggatggttacgtccagcgccgtggtgggctcatccgctatcagtagggatggactgcaggacaatgccatggcaatcataaccctctgcctcattccccctgacagctgatgggggaattccttcagcctctgctcaggagaagagacaccaacctttgtaaggatatccagagcctgcttttttatctcgtcctttgaaagactgctgtgtacggaaatggtctcctccagctgtcttcctatggtgagcacaggatttaaggatgtcatggagtcctggaatatcatggatatctccctgcctcttatccggcacatctccttattcccttttttggcaatatcctcgcccttataaaggatttcaccgcctgccacagaacccactgcatggggaagcagctgcaggatggacagggaggtgacgctcttgccgcagccggactcccctacaatacccagggtatcgccctggtttacggaaaagctcacatcgtccacagcagtcacggtccccctcttggtcctgaactgtgtctttaaatgtttaacctctaataatggctgtgccatattctacctcctttgcagggccggcaccgggaatatcccggtgcctttgctgcgtcatgactattctacatgccattcccaaacggaacggttcaaaagactgtaatcctcaaagcatacattggagattttcttgttgtaggcaaccaggtccttctggaaatacagccacacaaacggacactgttccctgagcatcatctggtactcatcatagaatggcttcctgtcctcaaagctgaactggttcaggccctttcttcccacctcgcccagggacggatcctcgttctgggagaagttattcagatggcccggagtcacgttcatcacgctctcgcccgggtcgggtgaaccgccggagccaatcagcgcaaaatcatactcgccctttcttgcggtggacagcagggtcgggtggtctgtggtgatgatttccacgttaatgccgatttttgcaaggtcctgctgaatcatgggcgccgatttctcgcgcacctcgttgccctttgacacattgaggcggtaggtcttgctggtatcaaatccggattcctccaccatctgttttgccttgtccacatcatatgggatgggaagaagttcttcattaaaatatctgtggcttggagccagagggcccggagccggtacgccttcgcccttcatcaggttattgaccagggcgtcgcggttaatggccatgtttactgcctggcgcacttcctggggaatgttcttggtattgcaggaaagatactggtaacccagggattccactgcctctgtggtcaggttttcctgctgtcccgccatatcccagtcatttaacgggatattgccgatgcctgcgccggccacaatatcaatctctccgttcatcagacctgacagaaggttggatgccggcacgattttaacaacaaagcggtcgaattcaggcgcgttgatgtggtaatccttattagccgtgaattccacgcgctcgccggatatctcagactcgtagatgcatggaccggaaccaatgggggctttccagaaatcagctgccagcatgtccttcacaggaatgtcctccagacagtgctttggcaggatgtaaaaatcgcggaacatgatgtccagcatataatccaggttggtggggtccttcagtgtaaactctactgtgttggcgtcaatggccttcacgccgaattcctctccttccacacggattccgtcttccgtaccggcaaagggagccaccttggaacggcgggccacgctgatgtcagggttggacatgagttctgcggtgtataccacgtcgtcagccgtcacaggctgtccgtcatgccacttggcgtttttgttcaggttaaatgtaatcttggtatgggtctcatcatccatggaccaggaatctgccagacggggtttaaaggatccgtctgcctttaccacaatcagcttgtcaaaaatcagctccagcacggcgtccgtgttggcattggtggtgttaaagggaatcagggtgtcccacggtgccgtcatggccatggtcacgattttctgtccctgggaagcagtgttctcctgggtattgccgtctgcgctgccttccgccttggcgtccccgccttcggctgctgttcctgttgcggcaggggccttggtatcgctgggcgctgaaggcgctgaacagccggacagtcccatcataagacacagggcaagagctgtcatttttgttaaacgttttctcattactatatcctcctttttattcaagccttttcggcattgattttgaacttattttcatgtatctatttgatcaccattttggtgtccagggcgtccctggctccgtctcccaggaaattgatacagagcacggttatcagcagggccaggccggggggaaaccagagccacggtctctgggaaagcacgctgatggactgggcatcatagaggatgtttccccaggatgcctggggcgcctggacccccattcccaaaaagctaagggctgattccgtaataatggcctgggccgcacggaatgtaaatgaaatgagcaccggggcaaaggtgttgggcagtatgtattttgtcagaatagtgccgtcctttgtgccgatggccctggccgcctccacgtaatcctgctccctggccgacagcacatttccgtagataagccttgcgaacttgggccagcccaggactccgataacaatggtaaccgtggccacagagggccccagtacagataccagcaccagaatcagaaccatggccggaaacgacatgaacacatccgcgcagcgcataatcagcgtctcggcaattcccctgtagtaccctgccagaagtcccaggggcacacccaccgccatactgatgactgcggatatgatacccacacttaaggatacccgccctccgtaaatgaacctggcgaagatatcccgcccgatatcgtctgttcccagccaatgaagggcgctgggcgccgaaccgaacatcacctcgtaatccgatgtatacgggtccagatgcagtatgtagggcagggcaatgaccagtatgatttccagggtcagtacaaaagcgcttaccatggccggtttgtgggcgcaaaaacgctggagcacgtcatgaaaataagaatttgccggaatatcctttaatctttcatcctgtttcatgttctcaccttccttcttcttaatcataacgtatccttggatccaacagtccgtacaccaggtctaccagcaggttgcccaataacaccacaatggcaatcaccaccgtgatgcccatgataacaggataatccctggcattgatggactgtaccatcagacttcccagcccgggccatccaaatatctgctccgtcacaaccgcccctcctatcaggaagggaatctgcatgccgaaccaggataccagcggaatccatgcgtttctcaaagcgtggcgcaccagcaccgacggctcatgaagcccctttgccctggccgtgcggacataatcgtcctggagcacctccagcatagagcccctgcactggcgtatgaggcttcctatctgctgaatggccagaaccacggccggaagcaccaggtggtggaagaacatgggccaggtcctgactccggaggaatcgtacatgccggaggtagggaacagcttcaccttgatgcagaagaaatatatcagcaccagtcccgcgaagaaattcggcatggcggacccgataaatgacagtccggaagaaatataatcccagccggagtagggcttataagccgacatgattcccaggggcagggcaatgataatggtcagggccatggcgcttcccgtaagaatcagcgtgggccctatccgctccagaatcatatccagcacctggccgttggtgcggatggacattcccatgtttccctgcaccagctgcaccagccatctgatatactggatgataaccggctggtccagtcccagttccttactcttccttgccatctcctcagcagtggcataagggtcgttaaacaggatttccaacggcgagctgggcgccagggaggccaccacatacaccagaatggtgatacccaagaaggtagggattgctgtcaacagccgtttcgcaatgtacctataacgttccatctgcatatcctcctcatttcatattttaaaaattccgttgccaaattttttatattggcctattataatattaaaagcgattctctctcccttcgcttatctcaatgcaaaaaggagttatacatggacaaccagtcaccgaaactatccttaaaggacaccgtataccagcagttaatcgagctaatctgccagggaaagcttctgcctgacaccctgttcacggaaaaccatatgatatcctacttcggggtcagcaaatcccctgtcagggaagccttaatccagctatgccatgaaaatgtactgaaaagcattcccagatgcggttatcaggtgactgccatcagcagtaagaatgtccgcgatgtgacggagctgcgtctctacctggaactgtccagcctccccaaggtcatggagaacatcaccacggctgacatcgaagagctgaagcgccagaaccaggtgcgcctggtaaatccggaaaaaaaggatttgtggatagcctggcgcaacaactaccagtttcacatgacagtggtgcgcctggcaggcaacgagcaggtgaacaatgccatggagcaggccatgaccacctaccgccgggcctatgcccagctgtacaccctgaaaaaggatgtaattgctgccaataaagccagttaccacgacttcttcgtgtccagcctggaaaaacacgacgtattctcggctcatgagtatctgaaaaaagatatcctgtttatggaggatgagctgctggggaccggcatcaccacctgatggatgccggttccggttttacctcttctccagcttttccactgagtccaccacgcaccggatgcggtcataggcgatttccgtgggaagggtgcagtctgagcccacgataaagggccttcccttcatctcctccagtacctcgctggtatgtttaaagatttcttcctctgtcccggtgaccaggactccgtgcctgtccgggaatcctcccagaataatactgtcactgaaaagcccggcgccctttgtcaggctgaaatcatttccgtaaatcccccagttcacaatggccgggtgcaaatccttatagcggttaaagtcaatattgctcttgcatatgtgcagcacattgaaatccgtggtctttttgatgtggtcatacaccattttctcatagggggccacaaattcctcaaactcttcatctgtaaagaaattccgctctcctcccagggccgcatagaagattccctccgcgccggcctccagggaacaatctgaaaattccataagagtctcagccacggtccggaacacctttttcatctcagccggacgttcccggcagaataaggtaagctggtatcccatactggtgtagttgcctgcaaaacctgtctcatggaaggcggaggcaataaggccgtggatggtggacatgatgggatactctccctttgccttgtcggctatcctcttgataatttccatctggtcctggaagatggcatccttcctggaaaatcccctgaacttgctgatgtcgcccagccgctcaatttttgtattcccgtcatacaggatattttcattcatgattttcaggatatctgtatccgtggccttcatgaagtccagatgggcctcaatggctttctcaccatgatgcatttcttccggaaaatgaagccagaatcccacaggcgtcctgtccaccggttttccttctaatacatttctgatacgttccctctttgtcatggtttccattttgttacttcctttccctttttgatgcatgtatatgtatattattctctcttctgatattattaataatattatcagttaaggggtatgtcaagtattttttgtgttatttggctattattaataaaataattcattaaatttgtacatttattctatatctaatatgttttataatattattagtacgggatgatttttgaatgtgagaaaggaaatttttatgaatatttatgaccagcgcattgcaaaagcaagaaaccgcatggaggacgccggcatttcactgctggtcatcacgccttcatctgatcttatgtaccttacaggctactcaaaaccagccacggaccgtctgaccgccctgctcctaaccgaacacgactcctatttcctgtgtcctgccgtggaaaaaaactatttaaaagaggtggactgtcaggcagcccccattttctgggaagacagcggggacccatttaaaaaaatgtactcggtcctgtccgcctcccccggcatatccaggaaatcctacataaaagcagctgtggcaggcagaatgcagagcagctgccttatccggctcatggaactgtatcccggcgtttcatggaacaatgcagacagtgtcctggttcccctgaggaagagcaagacgccggaagagattgccgtaatcaggagagcacaggaaatggccgagagggcctttgccagattgctggagaatggcctggaaggaaaaacagagcgccagttgtcagaacagctgatgaaactgcgtctggaggaaggctttgacgcagtgggccccggcctcattgcctgcggtccgggcagcgcctccccccatcccatcctgtcggacaacaaggtacaggcaggagacacggtaatgttcgattttggcgggacctataagggatatcatgcagatatgacgagaacctgcgccgtgggatatgcatcagatgaatttaaagaggtgtattccattgttctggaagcccacttggctgtcctgaagacagctgccccgggcacggcctgccgtgatatggacctggcaggccgcagtgtcatagagcgggcaggatatggggcatacttcacccacaggctgggccacggcatagggctggatattcatgagccgccctttgcctcagccagcgaagaaggtgtattggaaaccggaaatgtaatctccaatgagccaggcatctacctgcctggacagtttggcatacgtatagaggatttaatcgtgataacggaaaaaggctgtgaatcccttaataccatgacaaaggaactgatgattgtttagaaggatggccggaaatccgtatgaatggccggaggcaggtacggataccggggctatgggcattactgccctctcttccacttcttgatttcctccagcctgccttttacaggttcttccgcgccctggtccgtaggatgataatactccctttcggccagggagtccggcaggcactgcatccgggctatcttttcctctgtatcatgggcatacacatagccgtcgccataatgcagatctttcatgagtccggtaggagcattgcgaatggtaaggggcaccggctcagccagcatgttctgggcgtctgtcctggcggattcataggccatataggcagaattggatttaggcgccatggacaggtaaatcacggtatggctcagatgtacattacactcaggcattcccagaaaatgacacgcctggtaagcagacactgccagcgtcagagcctggctgtccgccattcctatgtcctcgctggcaaaacggaccagcctgcgggcgacatacagcgggtcctcccctgcttccagcatacgcgccagccagtatacggctgcgtccgggtcggaattgcgcatggacttgtggagcgcggatataaggttgtagtgttcttcccctttcttatcgtacagaaggctctttttcccgatgcactgcttcagcacatcctctgtgaccgtggtcttatccggactgattaccccgtttgtcactgccatttccagggtattcaaagccgtcctggcatccccgtccgcaaacccggcaatcatatcaatcatagggtctgtgatctccacattcagataacccagccctttaggactcttaagcgctgtctttataaggcgggccaggtcattctccgtcaatgcctggagcacaaagaccctgcaccgtgacaggagagcgctgttgatctcaaaggaaggattctccgtggtggccccaatcagaatgatgcttcccttttcaacatatgggagaaacgcgtcctgctgtgccttgttgaagcggtgtatctcgtccacaaataaaagggtcttaattcccatcctccggctgttctcagcctggaccatgacctccttgatttcctttatgccgctggtaacagcactgaaattaatgaactgggcattggtccgctttgctatgattcccgccagggtggttttgcccacaccgggaggcccccagaaaatcatggatggaatcttatcctgctcaatgagctggcgcagcagcttcccctttcccaaaagatgctcctgtcccacaaatccgtccaggtcatccgggcgcagcctgctggccagaggattgtatacttctctgtcatcgaataatgacatctgttccatggctttttatctctcctttcagaaaatggatctgtatgattactaagaaaccggatattctcatgttctggtttattttactgtgattttgccatatacgggcaaaaagctggaattgtattatcacaaacggcaaagcataatatattcttcccctttttcatccacaatttcaaatcctgttttttgatacatattcacagcataatttgctttttgtacggaaagtgacgcctgcttatatcctctgtctttcagaatacggagcatttctttcattaaagctgtacctattccatatccacggtaatctttatacagagaaactgcaatagacggagtggcattatctatatgtccgtaatcattcataatgcgtacccaaacagcgcccacagcctttttattaacctctgcaaccaaaccaatatcgtcttttttcgtcccgaaacccgttatatatatctgcaattccggctgactgataatggatttgggcggtgcaggcactccctccggcacaaagacagcctggtacaaaaaaacttgaagcaagctttcttctccctctgatattgttctgattttgtagtccataaccgcctcctgcagttttcaatttacagaggaattcgccccctctataacctggaatttctttcactatttctttttcttgttcattacaatagctattgtaatcgctataacagcacaaataataattaaccaaaaatttggatgcatatctttatctcctctgcaactgctgatatgccgggtaatctgcccagggcaggcaagcatataacttgcatataacttgcttttttcattctaatcttagcgcatggaaatgtcaaacagctcatttcttttcactgcttcacgctactgtccatattctgtctgctgacttgggcaccattatggcactcaacttaccttttccggattggttttcacctaatgattgtgccaatccctgaaggcaaattcctcatccatttcatcatatgcgcattccagcaaatcagatccccatccgtctgaaaactgaaaagccatgaaccgcccctgcaatgataaaccttccggaatcatggtcttaaccaacccttcaaagttgaacatgggaaacaattccctaagcctttcttccacatctgttttatccacggttccattattgggtacgcagtcgaattcatcagcccactggaaaacttcggctgtttcttttgagtatatttctttttcccggaactccccgcctccatttttcatacgccccggtataaccgcttgttctatctcccaaaatggatacccgctgcctgttaagtcactgaaaagccgatataatatacaatcattaatttgcttttcattctccctgatttctttttccttttgattgtagtacgcggtaagacctctggctattccgccactgtctgctgtctcagatttaagatagggaaacagcggcttgtaccaaaaggagtcctcatccttcaattctttcatgatttcctctaacgtatcgttaatcatgatattctcgtccccaaaatcctcatttacatagtttcctgctattcctatggaaaagctgcccttaacaagaaagcgtttgtctctatagattatttcaatcatatatgtgttactcctttgtttatgttggtgttttttgggcggatgttttttacggagggtgggggggtatgtgcttaacggattccctgttgaccgggatactgttaatatgttcttttaactgatgtttagcgaattttcaatatataattatggctgctttcaatgcattaggtacgtggggagcaattttccttttgcatcaatttaggggcttacaggtatcttttggtctgcaaggctctcgcgagcctcgactatatgatgttgatacaagcgacatcatttcattatttcaatccacaaggctctcgcgagcctcgactgcaaccagaggggtagtacttggtgccatcaaaatttcaatccacaaggctctcgcgagcctcgacttgtctgcactcactggtcaaatacacgaccatggatttcaatccacaaggctctcgcgagcctcgaccatttcacagttacctacggcctgtctaaaataaatttcaatccacaaggctcccgcgagcctcgaccgctggtgcaaggccgtcccatcggacatggcaggatttcaatccacaaggctctcgcgagcctcgacgtaaatgcaatagtactttttcctacactggaaatttcaatccacaaggctctcgcgagcctcgacgcgctgggttccggtgtcctccgtggcgaggagttatttcaatccacaaggctctcgcgagcctcgacgagatattttcctgtatctcctgttagatatttatttcaatccacaaggctctcgcgagcctcgacttatactcgtaaagtgattgacttagcggagacatttcaatccacaaggctctcgcgagcctcgacttgtttcaaagtttcgcaacatgcgcaacgtggttatttcaatccacaaggctctcgcgagcctcgacgaggggcttaagtccctctttatcccttcggatatttcaatccacaaggctctcgcgagcctcgacgggttatctttcagaaatttctcagctgcctttgtatttcaatccacaaggctctcgcgagcctcgacgttaggaaagggaggagtgactgcttcctttagtatttcaatccacaaggctctcgcgagcctcgacggcagacggggagcagatgggtgctgttattgagatttcaatccacaaggctctcgcgagcctcgacgccggatgcagaggtaagatatcagactaaaactatttcaatccacaaggctctcgcgagcctcgacctacgtcggacatgcccttattccggttcggtgatatttcaatccacaaggctctcgcgagcctcgacataaatttgtctaatttctatgcttgtttctctatttcaatccacaaggctctcgcgagcctcgacggattctatcgagatagcggcacggtcacatttatttcaatccacaaggctctcgcgagcctcgacccgttttaactatatttggcttactgcccaactatttcaatccacaaggctctcgcgagcctcgacagcaaaattatccaaaactgctccacatcccccctaacattttatgcattatgctcttctctccccagttcaaccaattcagtccattcacccagcccgctttcacggccttttcctctgtttttcaggtgcgaatctccctggcatttcatgtcagcttggcattcgcacctggtttgaagggctcccaactcacagaaaccaactctacttatatattacataatccttcatttcccgcatatatcctgcatgctgcaaagcctctgccgcctccgccggatactctttcaatacaagcctcttttgttccggatatatggctccctgcttgaacgcacggacaaattccgccatcacttccttcatatcttcggcatcgcaaatacgcagtactctgccctgacgttccattacagcagccagctttcccgccttcagggccaccgctgttccggccactgccagaaatccacatttttcaggtagttccagaacttttccccacaccagggccggatctgttccgtttaaccataccgtatggtcatccggctccctcaatgcgccggtcacggcatcataatcctctccgcggacaaattgggctcccgacatcccctctacaaaataacctctgcggatgcggcctgtatattcccagatacgaagaatttccaatgcctgggcccagctccactcccatttttttccatcctctccggtctggacatagggcgagtctgacccagcctgtacagactttctaaaagtctcacggcacagaatcatattttcatcaaaaaactgctccagccattcctccggtccatattttcttaccggccttactatatcccaccgcccagctgacagtgccatgaccctggtattcacacgttgtctcacagcagctttctttaccttgtcctgattctgccattgccttacaggcacaaaactgtctgcacataccaggcccttttcagccagacttaacaatacttcctgggcgctgccttcctttggtatttttgtaaggaatttaagaaaactggctcctctgcgctttaactcctggtacatgagaagctcatcgcccttaagccctgctgtctctgccccggcagatgcctcccagtctatatcctcatagctgcaaaaacaaagggttccttccggcgacattctccagaaatagtccccctgggccagcagccggtccagaagactggctccataccgctccacccgcctggcaaagtacacattttcccaaaagcgtacagggcatggctttctgcatcctttttccacggcttcccttaactgttcttctgccgtggaatgtgtcactgccctggctgccatcagcgcggcgtaatgagatgcgggctgtgtggctgtctgactgcgcaggctgcgtatatggccttccctggccctctcatagagcttttcgtgatagtatacgccctggtcctccactgcttttttgcagcggcatagtttatctaaaagcgcctctgtcatttcctcagacagaaaataccgttcccttacatccaccgcagtctgaccgccgcggtaatagagcatacgccggacgatgtgcattgcggcttcctcatcctgctgctgcaatgccctcatatattcgtcctcatgttctgccgctatccagattcccggctccacataacaggccagtccctgccgggccagggcctccagccagtcagcaggtatatccagctctcctgcctccaaatctccctccatcatgagaagcgaatggagctcctcctcattttccggcatttttctccgtgaccatcccctggacagttcctctggtgtgggcttaagcaatgcttttttcaaatcttcctgcacggtctggcggattttaggcgtcaccggtgaatactcatacatctcttctgcctctgcctgccactggaagggcagagacataggagaagggacatccagccagatttctctgaccgtaatgaagccggaacggatcctggccagtatctccatcactccgctgatatcccactggtgttccagacattcccgttttgtctcacgaatcagcggatggtgcggatggtccatcagggagcttaacatttccgtgctcttaagacgctgcatccaaagcggctggcgcccgttccgtttcatgcccatcatcagggcgcgggcagcattgtagcggaatgtcatgccgaacagaggcgtatcaggcaggattgcttccagcaccggccgtacctggtccgggttgatttggaataaaagtccttccggcaattgctccctgccgtatggatacagaaggaagccatcctcctcatccacactccccacatccatccccatggtattgcgtatcatatgacgcaggaccagggacagcggaccatttacccgtcttccaaacagagcatggaccatgacctggtggcttcctgtactgtccttaaaatgctccaccactatggttctgtcatcaggcagtccttctgtggcctgaatctgacgtgttataaatccggacgcatggaccgacgcagactcgtctaatcccagtttctccagagctttttccagctctccctcacggcatgccttctccagctctcctaatatacggccaaaggcaagactggttctaagatctcttccctttgtctcccctttccagaatggaagtctggcgccttcggccggggcctgggtcacgataacagagtccttatcctgacggaccacacgccagccaaaggaccccagcatgaaccggtccccgatcctggattcatagacaaattcctcatccagctctcctaacttcaccccgtcctctgttttggctgcgtacatccctttgtcgggtatggtccctcccgctgccgtggccagcatacggctgtaaacatccccagccacccggccgtgaatccggtcatacaaaatcctcggacgcaccggtatctcccggctgtgttcgtaatctcctgccaacatggcaaggacgtcctccacatccttcctggtcacctggtaaaatggatacgaccgctccagcacatccatcacatcatctatgctgtagctctctcccgaagccatggaaaccaaatgctgggccagtacatccagacacatgcgcggaggattggcccgttccacgcctccacggcgggccacttgcgcggtcataccgcagtatactgattcgggcgcagtcctgggatacatatacatgacgctgacccggcccggattatggccggcccggcccaggcgctgcatggtgctggaaatggtgcgggggcatccgacctgcagaacctgctccacatcccccacgtcaatgcccagttccatggacgacgtggcacataacagtctcagcctcccctctcttaaatcccgttccacctcatccctctgttcctttgacagacttccgtggtggactctggcaaacccgtccccgcccaacagatttacatagtatgccagcttttccacataacgccttccttcggaaaatgcaattacactcttacaacttaagcactggcggtatactgccattcccagctcttcccataccggatccttccgccttcccacagcaggagccgtaccaatgacctgtatatccacctgtttatccatggaaggtgcacagataacggccggttccggggacaggtaggcggccgcaagctccagcggctcaatggtggctgacaggccaattctctgaagcctgcggccgcaaagtttatccagcctggccactgacagcatcaggtgcgcccccctcttggtgtctatgagggcgtgaagctcgtccaaaataattgcctttgcagtctttaacacctgtcggccggatttggatgtcagcatgagataaagagattcgggagtgataatcaggatgtggggcggatgctttaccatcctctggcgctctttctgaggcgtgtccccggtacggatggcggcctgaatctgccctatggatggattacccggtctgctttccgctttgctttccccgtgagcttccgctccgattccctccaaaggtttgcgtaaattttccctgatatcccccgccagagacttaaggggagacacatatatcacatacagctcctccttaagttcccccctctcagccagtccgcccaactggtctatgaacaccaggaaagctgaaagggtctttcctgtaccggttggagcgcttaccagcacgtgctttccgtcagcaatggcgggccatgcctctctctgtattttggtgggttctccgaatgttttcctaaaccagctttcagtggctggcaggaattgtttaagggtatcctcttgcataagctcctccatgcgggcagttgtgtgtcattcctgttgtctggattatgttccgtaaaactacaggtatttatattattatatcattgcactgttttgcctgtctatgactgacatggcagaactgcctttctgaaaggtcttttccggtctttcatttgcagcagttccggcgccgcctgtttccttaacactaatcttattgtataatatactcatatcaataacaggctgaatcagaacctgtgggaatgaaaatctgaaaatacagcagaaatctgataaaacaaaggaaaggaacaatcatggacaaacggaaaacaggcatttttcttctcatattcctgcttggactcatagccggattcctgctctccagcgcggtgagaggacatgcagccgcagatacttccggttcccggatatccggcagacaggaaaacgtcccccttataaccaccggagaggactcagcactcccggcttccccggaacaagccgccgtcagcatccctgctccccaggccatactgacctccggaccgtcctatgctgagtgggacaaaaacaccacctatacaggcggcgatcaggtggcctgcggcggtaaaatatacatagccaggtggtggaccttaggggacattccagggcaggccgatgtgtgggaggctgctccgcagacgccccctcccgcagattcccaggctgctcccaaagccggcgcctcatccccggtaaaggtggtgggttattaccctgactggaaatcctaccagccccaaaagctgcagatggatgtgctgacccacatcgcctacgcatttgccatacccacaccggacagcagactgctccccctggaaaacccggaaacagcagtccgcctgatagaggacgcccataaaaaccaggtcaaggtcttattagctgtgggcggatggagctataacggtgccgagctggaaccagtcttcgtgagcgccacttcaaccagtgaaaaaaccaggcagctgggcgatgaaatactggccatgtgcaatgaatacgggtttgacggcgtggacatggactgggagcatccccgggtggacgggccctccaaggaccagtaccaggagctgattctttacctgtcagatgcgctccatgcccagggaaagcttctgaccagcgctgtcgtcagcggggtcagcgcagacggcaatatctattacgatgccgcggcccacagcgatgccgtgttaaacgcagtggactggattcatgttatggcctatgacggcggtgacggggaacgccattcttcctatgactttgcagtaaacagcgccgcctactggtgcggcacaagaaaaatgccggccggtaaagtggtgctgggtgttcccttctacggacgtcccggctgggccggttacggggatatcctggccgctgacccggatgccgggaataaagaccatgccatggtgagtggaatggatgtctggtataacggcatttccaccattgaaaaaaaggccgcgtatgccagggataacctgggaggaatcatgatatgggaactgacccaggacacggacgattccggccaaagccttctgtcagccatcggaaggggcatacaatgatccctgtgttccgctgtttatcccagcggattgtaaggacatttttccttcaggcactgttcattccggccgtacaatccgcatactgtctttttgggccgctccatccatatcccgaatttctcccccacaaaatccactgcctccagtatggctgtgtaggaatcccgtttacagcatctgggtccccctgttttggcaatagccccaaggcttctggaggtcatctcattgcaaagcccccactcttttccgcttaagggtgaggcccctgtaatcaggctgacaaaaatacctgtactcacagcagccccgcaggttccccacaaaccgcagatacctcccggcacctgtgcccccctgttcctcatttcttccagggccgcgtccaaatccagttctcccccggcgttcttataggcagccagaagcgcggagcccaccagcacatggtgctccggtccatgcatatagatatagggagacaggatgattttcttcatgattgccaccggatccttgctgtctgtatgcctgcatatatcttcaatgacacgcaggcccatctgctcatggcagctgtcgcagataaagtgaccgttcatacatctggcattgctcataaatgttttgtgacagtaggtgcattccatttcaatctggctctggagatattccaggggcgcaccgcataccaggcatcctgttgtttgttcttctattgtttgttcttctactgtttgtacttccattgtttgttcttccattgtttgttcttccattgccgtatcctccccttaaccattcatttcttattcttaggccaatctcatttcagtataccataatccctatcccggttaatacttatttttctgtttttatatcggttttcacattcacttcctgccctccgctgttcccccatccccaccctcgtcctgacggttcttaccgcaaatcgaaaaagagcgcaaaccgcacggaaccgctcccggaactggtttacactctttttctctactctctgctcagggtagcgcctgacctggctgtgttcaccaggcgggcgtaccggccgaggagacccttttctcttggacgcgtcactgccttccattccctgcgtctggcttcaagttcctcgtcgctgacctccagatggaggtaatccttatacaaatccacagttatcctgtccccatccttaaccagggcaattggacctccctctgctgcctcagggcacagatacccgatgcttaagccgccgctggcccccgagaaacgcccgtcggtgatgaccgctgtgttgggtattcccttgatgatttccgtaatccggtgcagctccttcattcccggacctccctttggaccttcatagcgtacaataacggcatcaccttcctttatctcctttgcccggaaagcagcataacactcatcctcgccctcaaataccctggccgtgcccttaaaacgccgcacttccatgggaactgccgatgtctttaccagggctccctggggcgccagattgccatagagcacctggattccgtctgccctggatacaggatcgtccatggactttataacttccctgtcgccctgagatgtacgctccagaatctgccccagtgtttccccagtcactgtcagcacatccttattcattacagactccagctctttcatcacagccggtattccgcctgcatagtgcaggtctaccacggtccggtttccgttgggtacaatggagcacagtaccggcgtggcagtggtaatctttgaaaaatcatcccagtccagggaaatccccagctctgccgccagcgccggtagatgaatcagggcattcagggaccctccgatagcggaaagaagggtaattgtattctccagcgcctcccgtgtcataatctggctggggcgaatctgcttctccaccatcttcatcacagcccgacctgattctcttgcgctgaaacggcgcatgctggtacttgaaggaatcaggcttcctcccggcagcatcatacccagggactcacagagagcgcccatggtattggctgttcccagaaagggacagattccggggcccgtgtaatatttgagcgttccctcaatcagctgccgctctgttatctctccccgcaggaactgctggcgcagttcctttgactcattgggttttatctgggcatagcagggaccggccgtgacaataactgaaggaaggtcaatccgtgctgctgcgttcagcattcccggcacgattttatcgcaggaacccatgtacactactccgtcaaacactccctcgcccaccaccatggcctcaatggaatccgtgatgatttccctgtggggcagacagtatcgcataccggaatgtccctgggcaataccgtcacacatggctaccgtgttaaactcaatgggctcgccgccggcttccaggattcccttctttacctcctcagccagctgttttaaaggctcatgtcccggacatatctcattccagctgttggcaacggcaatgagcggcttgtggtccagggagtcgatggaaacgcctgccgatgccagatgggccttggatatggctttctggaacggctccaatttatcaattgcccgcaacatcatttcctcctgctaacattgttttcttcttgttataacgattcatgaacacccatacggctgccataaccgcaatcagtaccggcacaaaaatgtacggcttcttgatgaatgcctcgtacaccagaaagcttaccgtaaggctggtggcagcgaaggatgtaatcattccttcccccaggtccaggcccacggaggtggccagctgggtcaggacaggcgctgtagccgtacctgccagcaggatggcccctgtacacaccaggcccatgatgatgttcttaaacaggtttcctctggtaatagcaaccaccagggccacacggaaggtcacaaccgccaggtccgcaaagggaagcacgcggtttcccggaagtacggcagccataaggatggttaacggaatgacaatcagggatgtggtgatgacatcaggatttcccactacaaccgccgcatccaggccgataaggaatttcctgcccttaaacttctcctgggtaaactttttggcagcctctgagattggcataagtccttccataaaaagagaggtcatcttgggaatcaataccatgacagccgccatgtttacgcccaacgccataatatcagccactgaatacttggccagaacaccgataacgcagccaagtaccaggcccatgatggtgggttcaccaaagaatcccagatatttcttggcatccttgatttcaaaatcaatcttgttgattccgggtatcttatccagcagccagttaaggggtgctgcgataatgatggaggaaagagctgacatggttggaagggatacgccgggaatgccgaagtaatcctccaccagaggcgcggtccagtctgacagcttaaatgtgataatggccatgatgaccgttgcaccgatacccattgccacatttttagtcacaaaataaaccatgattcctacgattgccatgtgatgataattccagatatccacatccagggtatctgtggccttcagtaccagcataacaatgttggtggccagaatacagaatataaggatagcgataatcggcgatgaccatgtaactgccgtgatggctccccagcccacatccagaatatccagcttaataccgaaattctgcaccatggcctgggcggcaggccccagattgctcttcatcatgttgatgaccagattaatacccgcaaagccaatgccgatggtaaggccgcttctgaaagcctttgataatttcacccggaaaataagccctatgatggttatgatgattggaagcatgaccacagcgcctgcatccagaatcgtattgaaaatattataaagtatctgcatatgattaatctcccctaagatttcatttgtctttcatagcccacggctgtctgtcctgagcgcgtttgaggcacactcaacccctttttatttcagatgggacagaatctcatccagcgttgcatcctcattaattcctgtcagcagggaaatggcgcctaccaccgggatattcacatttccgcccgtaaactttcctgtggtaaccagcaaatcaaaatcatccgccttggattccacctccagaagcttgcactgggttacagataccgggattccgttgtcttcacatttctccctgattttggttgccactaccgttgatgttgcgattccatttccacatgccactaatatacgtttcatttttattttctcctttgataatctcttttagttttcatcttccagcagatactgcttgatgattttatggatggtgtcaggctgtcctgcctccactatgtgtttcacatcctcctggttctgaatcagttttacgattcgctgaagcatctcaatatgtccgtgggcctctgtcagggccagcatgatgaccaggcttaccggtacgtcattgtcaggctcatccatggccctgaagggagccggtgtcttaagcaccgccacgcagatggccgcctcattgacatggcagatatccgcatgaggaatggccacgttgattcccccggtcttaagacctgtggggaaggactgctcccgctccaggatggcctgcttatatgtatcctttacaatgcccttttcacagagataatctgtcatggcagacagaacctcccggtccgtcataggtttgtcaaattccagaatcaatgattcattaaacgcaatgccgctcatgattctttttcctccatactcttcattttctcttccatggctgctatggaaccgcggattccctcttcattttcattcagtatatcctctttcaggaaaatacccgaaccgattcccgcaaatgatgcccctgccgcaaagtactcctgtacatttgaggtgccgatgccccccacgaccatcagcggcattttccccagaggcgcctggatgtctgacacatatctgctccccagcctgccggcagggaatatcttcacaatatccgccccgtccagaaaactctgtctgatttccgaaggtgaaaaagcccccggtacagacaccacgccgcgctcccggcacaggtccaatatgcgcttttcaaataccgtgggagacaataaaaaggctgcacctgcctcaatggcctccacggcttcttcataagtaaggaccgtgccggctcccaccatgatttgtgctccaaattcctggctgattttccgtatggattccagggctcccggagtattcatggtaatttcaacggagcctaagcaggtccccaccaggttcttgacaaccgtgcgggtctgtgaataggtatagcctcttaagattactgtcactttcggaaatttttctatattcatcattctcgctcctttctgacaatatataaagcaagaatgatgccaactaattgactgattttgtatttttacataaaagattacggatttcttcccgtgtccggctggcgcggatagcagaaaccatggattcatcagaaataatctgatacagctgttcaaaatattttctggaatcctcctgaatggccagcacaaaaataacatccacggtgttgactccatcccataaaacgggtttgtctaatttcgtaacagaaatgactggttttgtaaccaatccagggtcgccatggggaatggcaatcccctggctgagccgggtggtcatcattccctcccgtttatagacgctgagaaggaattcctgccggaccaatccttcctctgccatatgtcccactgcctcatctataatctggtccttaaactccgcctctgtccttatatagatatggcccagagagataacctccgacagctggttttcttcgaacatggcactccgctttaatatgccgcgaagctgcctgatgccctccgggctgtaaacccggcttacagatataaacggataagtgcctgaatccggattgatggtgcccacaatagccagtatctcatactccttttccgtgttggcaatgatgcgatcaatgctggaatcctcaatataccccctggtcactacaacggtcccggccaggttgctcttcaggcgttccatcaaatgttcctttaattttacggcagctccctgtcctgtgatgcacaggcacaaaatcgcttttttcctggactcgctctgttccctggttccggtaagtttaatcttgtccagttcatccgcaatctcgttcagggattcatccgtccacatggtctttcgcactgcttccaccaccatcatggtgtctgtacggggcagcacccggacctgcatgcctgtctcctcccgaatcttctgtcccacattcaggagtgagcccatgtcagccagcacgatgcagccttttccctggttgacgcgcctggccatatccactgtcttttccgccatctgagccggcgtatcccacaggttcatatccactccaacagcgtgttccgttcccatgatggcattggcaacctgggccattccgctggccaccgggccatgggataccaccagcaccccaattctcccctcctgggccatgtcctttttcctgaattttctgaagtacatggccaggaatgccttttcctcttccggcagggtcagataatactttttctgtatttcatccacagcatagcaggcagcttcataatcctcgtaagactgctggcgaatattctccatgcctgggtacaccatacgcccgtggctgcgcatccgctccatggccatgttcagatgaatggccagaggaaataccacctgttcctccagcccgggaagccgttttctggccagatcacagatgtccctcgtcatgcgcagaatgtcgtcccccacaatagaggcaatctcgtcctcccgtatacccgacttctggaattcatggatatggcgctggaaccttgactctatctcgtcggtgagctggacttcgatgtcctgttccctaaggccgtccctcagcagctggtcatacttttcctccagggattcatatatgttaaagccctccaaaaaggtttccgttcctgattttcctgctgattccccggtatcatcgggaaacacataacagtcgtcagggcacagttcctttatttctttagtaatccggtcaggcacataacccttcctcaggttctccgtcaggctggcgaatgatacagtgatacgtccgtcctttctggcccgtccttccagaaacgctttggcacagcacacctgtatatccgatttaagctgtcccacattgcccgggcagtccccgcccaacagacaccagagcgcctgctgccttatttttatctgtttccccagacgtctggattcccactggaaaaaccgcaggataaactgcagcttctctcccgccggccggtcctttaaggagggaatttctatcaccatgggaatcctgcgcctgaaggtcagaagcagggagctctggggattttccgtggttgcggcaatgaccatcacatggctttcccgctgggtatccacttcccccagacgtctgaacctccccttatccatcaggtaaaaaaggatctcctggccctccgggggcagcctgtgcacctcatccaggaacagaattcccccattacacagctccactaccccctttttgttgtcagaagcgccggtgaatgcccccttgctgtatccgaagagctgggccagcagaagctggggattatccgcataatccgcacagttaaactcaaagtagggggcgtccttaccaaaattttcagtaccgcaggcatactcatgcatgagctccgccagaaagcttttccccactccagaaggtccgtatataaggcagtgcagacctctgggcggatacagcacggcagcctgggcacgggtaatctgagtcttcatgctaccgtcaaaccctacaaaagcgctgaacgcattagccctttcatcctccgccccggattccgcaggttcttcatattccgcatgtttcgcatattccgcatgtttcgcatgtttcgcatattccgtatgttttgcatattccgtatgtttcgctaaatccggtgccagaccggctccctccttctcctggcaggcgccaaaaggagtccatatctccaacagttcctcccgcagcctgcctgcggcatattttcctatcctgtagccggcttcctccagcatcctggtaagcccgcggtccgacatgtccggatgttctgtcagaatccgcttcatgtcctcaaatataaccggcttcctccgcttcctggaatcaggtatatggtgatcccggcgtaccgtggtcacatcctccctgaatacctgcagtcgggacgctatctcctcatctgttaggggattcttactgtcctcaccttttatgatttgcaatatccgttcttccatgcgcgcattctcccatacaatgatacagcctgtttcaatgagtattatcataccatcttttgatatgatttaccacatggcaatccagccagcttcccctattggcagttacttacaaggctctgcgccagacattcttccaaaaactccacacagtattgttccagatgcatcagcccttccttttctattggaaaatggcccgccccctttaacagcttcatatccttgctgcaattcagtctgtcatagaatatcctgctgagactggcatctgtccatctgtcattttccgggtgcaccagaagcacgggacacctgctaaagcgctccggctccgggtggatatggggatttaaaagtgtgtgcagaaatgccaccggcacctttgccccggaagaacgcctgtctctcatcagcacctcagccagttcctcatggtttacgattgccttcatattacccacccactttacgggcacttttataaagcccagccatgcggatgcctttgatatgagcctgaggccgtgttctaccatccacccggaactcacaacgcttttccggaccaacggctctctctggtccagaaggcaggttgctatcactccctgaatctcaggcagtccggatgcagtctgatatgccaggattcctcctgcgctgaggccgaacagaaaggagggccttatctccctggcctgatagtacatgactatctcagccgcgcagtccacccaatcctggtataccacctttccgtaatactcggtcattccatagaggggaaggtccggacagattacctcgtaaccctgcttcatgaggggtactgctatcaaagacagaagccttccgtttccccccacaccgtgaaacagtataacccgcgcctttggttcctttaccctgtagtggtctatatgtatgccaaacctgcctattcccacaaaatactcatccggccgccaaaccccggtcagccggttttcttccggcaggtattcctgtactttcttccagtatccgtcttttccgtaatacatatgtgtccctccgctttgcgtcattactgtttttaagccatgagccggataaaatgaacggtacggcaacgcaaaaagacatagcccgcattctttatgaaagatgcaggttatgccttgaatctgccggtgcataatcctatattgttataatcacaatcctggcttccgccgctgtcagcgtcgtccatccttattccaagctcctcttgccaatcactaaaatagttgtctttacatagttatgttaaagttatattgaaatcattgtgtgaatgcagatacctctgtattatgcagcattatacgggatgggcggagggttgtcaacggtatacacggaatcttagcggatttttaatatacgtgaatttaacagattcttgcccccacccccatccatcctcatacgccgcacaacattaaaaccgcaaaaaacacatgccgactcccaaccccaaaaacagaaccgttctgctccaaggctcaatcccttcccatcctgtcctcatataccttccggtaatcctccaccatgcgttcgtattccttccgttcaaactgccacaagggagagcatatccaggttatattctcctccctctgcatatagggcttcgtatagtttcgcctcctgcgaatcagctcttcatcccaatgttccgacacccatttcctgtattcaggactgtcaaattgctcacatgctatgttatccccatattcctcccagtcctggtccgaatatgcttccaggcacaggatacctgactgcttctccatccggaaatcctggttttccaaactcagcacccccagactgtcccagtatacagtatccggttccttcctgattttcgccattatgacaatgcagctcaaatcacagtcatcctcgcacacaagtacaggcacattcaagtcctccgacgaatccaccatctcccagataaaacggttctcagccttccacaccagctcacctgtccacgcgggcagaagtccttccagggagccgaatacttccagcctgggacatgcccctgcacttaccgcctcattcagatatctgacaataggtctgccgtcaatcatccagtagtattccccgtaatcatatatggtttgtaccagctccatgtgaatccggttcatgtattttcctcctgccttattccccgctccaaaatcccctgtcctaaaaccactttttcctcttaaagaaccatatttccactgccacaatgagcagacagagaatgcagatcactgcgtagccatagggaaagcccagctccggcatattgacaaaattcatgccgtaccatcccgcaatcagggaaaggggcatgaatacagtggtcacaatggtgaggaatttcatgatttcattctggcgtatgtccacctgggtctgatgcatttctcgcagctgcatggaatactccttcatcatctgcaccgtggaataaaggcgccccgccttatcggaaaataggccaaacaacaggctgtccctttcattccctctctcggccgcatcctgctgcagggtttcccccatgtcggagagctgttcatagtaaacgctcaatgcggacaaatccttcctggctgccaggattttcacgtcaaattcctctgactccctcttaagcagtccttcctccagatgtgtcaggctgtcctcatactgctggagaaaaatcacatcctccttcagcagatattccatcacatcaaaaagctgcagggaaggagatgttacatctgtcatctggtaatcctgcatctcatccaaaagctcccttacataaccgctgtcatccataaagatcagcttttccccggtaaggcaatagccgaatacctgtttttcctttgacgggtcctccttggaaggaatggcaaatgtgcctgccaccgctgctctaaacacatctgccttgcagaaccgtatatggttcagaccgctgccggaaaatattctccggtaaatatccgggcaggcggtccgaaactcttccatggtaaggatttcaaccggatgggacttcccggcggatacaccggcatccgggtcatccttgctgtgatcattccaatggtatttcatatggtatcccccgtgcttttttatgtcattgtaacacggaacagccaggacgtcaaaaggccgggcgccatatatcctgctccaatcctcctgagagagctccaaccagtgagcatagtaaaatatccagaagggtatccaatagacagatgaattttcttgcccttgatggacggattcatcatcttgcgatataataatgccattaagcagcaacaggttgccgcagcttctttatatatcaatccatagcaggtgggtaaataatttatacaattacagaaatgacagaaaaacactataatggcaaagcacatgtccaatacaccgcctggtccgaaacatacaggggattaatgccgaatgaataccttgacagcagaacgtttatggcttgttataagtccacgctggaacatccccagaacacctatgtggcccttgtggacgaaacagtggcgggcttcatatggtattcaccggatgcaagggattatacacacagaacaggcatgtctgaaatcaatgcactttacgtactaaaaaagtatcaacaccttggaatcggcaaagctctgatggataaagccctgagtatgctcccccataagacagcagtattatatgtcctccagggcaatacccctgcaatcattttttatgagcatatggggtttaagtttaccggtaatacatttacgcaggataccggattcgggaatattgttgagcttgagatgatgcgggccggcagataaaccggaccataagcctgcgcctgcggttttggcatagcagacaaaatacaaacaaacaccgggaaataacggccctatgtccgtatctccggtgtttgctgtcatgatctacccttatgcagtacttttatgccctgctttccttttctatttcatggacttcaattgctatttgtatccccatcctctggcaccataagctttcccttgaggctggaagccattttaagagctggaaattttgcgtgataaagagctatggcctcatccgcgtctttccggttcatcgtaaattcgtattcctttccatccgccatcacgcacaccagctccgtactggtgccgcgcccaaccttctttacctggaaccgaacctttttaagttcctggttcaccagaatcactggcttacccacgattccatatgttagatcctcgccaatccagaatgtgccgcttatcttccgggcattccggaaatcttcatccagtctttccctgtttatggttttatgactgtccagaaacgtctgtactgctgcaacatgatgttttttaagcatggaggacaggataaatagcccaaggagcgcgataacggccccgaggccggtggttcccatggcactggagggtgtctggttatccagcatgcctgcccaaaaataataactctccgtttccgtctccaggtcaaaactccggaccgccctgtcatagtattttttgccatcacccttcagtttcttcagggtgccttccacgtgcattccctgaggcggctcggaacgcacaccctttaaataatcccgggtttcgtccataatccggtccatttcctcctccattttaccggaaatacgcacaggaacagctcccgcctcctcatccagcaccagataatatatactgctcttagtgcgcaccccgctgcgggtacggtagctttccatgaaggcatccagcacatagtttatatcaaagcttacatattcatccccggcctgttctgtcccgtatacttcacggagcggaactgcaccccgaaaatactttatcagatagctgcctaccagtaccatcaggccaatcccaaaggcagttaccaacagacctacaggcacattgacgcgcaccatggcctttttgaattctgtttccaccgttctcctgtttgtattatcgcttcccataccatatccccctcattgttatcccggcagtaccgatccgccggcagtgtcaattccgggacaccggctctccaattcctcctgaagcgccctggcagcctcccgtgatgtctcggcccatgctgtttttttatcctcagtcatcagatggatggtcaggtaatgagcctgctttctggtttttccgactttcacatagtatgtattatccttgatgtacgcttgtgtaagccggctgagtttcaatacgcatggcatgttgccgccgtaaagacagatataatccctggtcagaattcccctcttctgcccggtggtaaaggatttcagctttccaaggtgattcagaatcaggctgtccggacccatggcctgtttgtcaaattcccgtatctcctgttcctctaatccgccggccttggcagcaacgcgaatccaatcatccacagtctttctaatatctttggttataaaaaaaacagctactccgaataccgccaccagcaaaagaaagaaaaccgaaatcccgattcccactcccagcatattttcctctttatcccggatgatttccagggttctgtttacggaccagaccaggccggctatactgcccgccagaaaggctcccataaaaaacaggcccaggcccgcattgactcccttcatggcctttttatgagccttaaacacagatccttccggataatgcttttgcttgtactcctcgttcatactctctaagtatgtttctttgttctgggctgtcatatactgtttcctcctcttttgtaacaatggcatttccgtgatagaatgcagaaatgtttcagtcattctttccagttttattatacgtatgaatcgtaaaaaaacaattggtacagcataagccgtactatttcggcacaaaaagcaagacggtatcattcagccatctcgcaaatcaatttcctgaatgaaccgtcctgattcttccctgtaactgtaatgtccttgatattttccaataatcccccgtatgctctctattccaaacccatgatacctcttatcctgttttctgctttcaagattgggattgttcttcagcacagaccctgatatggtattttccatgaaaatctcggttgttccgtcctcttccctcaccaccagctccagttcacgttctgtctcaaccgccatgcaggcttcgattccattagaaagcagattatacaaaagggtgcccatgtccatgctgtcaatcctgtccggccttcccataaccacataccggaaccggatttccttttccctgcactcctgaaccgctttaataagggctgcatttaatccctcattgcctgtatcctggggcagttcaggatagtttcccaggtctgctcccatgcgttcaatatattcggccgcctctgcgtaccgttcctttgccaccaggcggtacaacacattaaggcgccccttcatatcatggcgcaggcggtttacctcccggcccattctgtataaatcccgaatctgttcctcctgctggcacttggtttctcttttgaattccgcctcgcgttcttccctccggtaccgctccagcctgtggtaaaagcctcctataaaaacaatcaccccaaaaattcccattaacatacaaagagccagaacatatctccctctctggtccagtctgccttcctccataagaaacattcccataatcagaataaacatgcagaaaaatgttcctgccagcattccatcctcagcctggaccggtccctttttccgtccatacagtgccagagctgcccggcccatggaaaatttaagggcacatcctgccagtatgggaaataccaccgcgtcccggtccataatcatcagtgtattaagacttctgcctgtaataatccccaatgtcccatagatcatataagaactgctgatggctatcagaatccacaaaagactgtggacaatgaccttttgcgccttcccattcagggcaatcaagccatatgctgtcaataccacgccatagctgattcccaggaatccttcaaagacaatataacggttgagcaggaccatgattccataataggcaaggcatccgcctgtaaacagcatgattcgggcagcaccggaatatttcttatcaaaaccatggtccatatattccattgccacgagggtggacaatacatcaatcacataagcggctgccgtgctttctcccatactccatcatcatctcccttacgcctttttttctgtcccttcccataggaataactgccccgtttttaagaacagcatcctgtttttctatctgggaaatatacgcctgattcactagataattccggtgaatacgtaaaaaaccataatccctcagttcctccgccacaggctttaagctcccgtaaacagagtactccgctccgccggacattttgtaggtcagtgtatggccattacactctatgtacatgatatcccgcagaagcacctcgcctgcgccaaagcccccctgaattttataactgattttcctgcgggccgtcacctgaaaatacttctgcagcgcccggcccatatcccgtttcaaaagtcccttcctcacaaaccacaggggcatatattcgtgggcatcaaacacccagctctcatgactggaaacaaatataagccgggtctccggacagctaatgcccagctgctctgccagccagaacccatccctctccggcatctcaatatccagaaacaccaggtcaaagggatgctgctgccctgcttcatataacctgcgtccatcggtaaaaaggcttacctgcatgtccacggttcccggcatactgccgatatactcttttatttcctctttaatctgctccaggtataccctgtcatcatcgcagacagctacgcggagtgtttccatgggattgacccccttttttattcttatgattgtgggcaggtggtgcttgtggttgggttggggttagttgggttgagttggcttgggttaagtttggttttgttgagtttggcttggttgagtttggcttggttgagttgagcttggttgagttgagcttggttgggtaattttcgcagcattggggtaaattgtattgagtaagttgcattgaataaaatgcattgggtaagttgcattgagtaagttgcaatgggataagttaagtcgagttagattcatataatttaatccggtttaatcccatgtcttccatacttcgggctgataaccaattgtagccttcttaccatttctgacaatgggcgacttcaggactttctggttttccaggactttctcatcccggtcttcagcagcaatgtacttgattaatgccagtgcgtccttatctttgcaatcatcattcaacataacatccagacctcccacggcctgcttcacacttgtgtattcccccttactcatgcctttttcttttaagtcgattaattggtatttgatgttccgctctttgaagtagcgttcggctttctttgtgtcaaagcatttttttgttccgaagatttgtatattcattgggtaatcctccattccttactataacaatgcttccaggccggatacctggaaatctgcggcatggtctattgtcttgccagccgaggcctgccgatgaaatttctctgagccttgcaaaatctaaaaatataatgtataataagtatataaaagagcaaccgcccacaaggtggaagcctacgagtcaatttacgtcctacatgaggacgcgcctatcctgttggctgacagggtaggcattttttatttcttgttatgcctgtctatgtaggtcagtaatgcgataaggaacgagccgcccaaaaagagcagacttaaaatttcataagttcccatactacatcacctcccctctcttgtaagatgggaggctgccaccctgtacacggtgctcatgagagcattatagcaggaaatttcctgataatcaactggcggttcccaaactggctctactatggctctatgtgttataatgtcaaagtaatgtcacggagacataaaaaagcccgggaacccgcataaacactgggttcccggaacttagacaactattcgaactcaatcgtagccggcggcttccccgtgcaatcatacagcacccggttaacccccttaacctcattcacaatccggctggtgaccttccccagcacttcccagggaatctgagctgactccgcggtcatgaaatcagatgtaagcacagccctcagggcaacagcataatcataggttctctcatcgcccatgcagccaacagaccgcatattcgtcaaagctgcaaaatactggcccagattcttgtccaccccggcctttgcaatctcttccctgtaaatcgcatcagcgtcctgtacaatgcggaccttatcagctgtcacctcaccgataatcctgacgcccagaccaggtcccgggaatggctgtctgaataccagatactcaggtatacccagctccagtccggcctttctcacctcatccttgaaaagcagccttaaaggctctaccagttctttaaaatctacatgctccggcagtccgcccacattgtgatgagacttgatgacagcagatttacccaggccggactcaatcacatccggataaatggttccctgtaccaggtaatccactgcgccaatcttctttgcctcttcctcgaatacacggatgaactcctcgccgatgatcttacgctttgcctcaggctcttccacgcccttcagcctggcatagaaacgttcctgggcattgacacggatgaagttcaggtcatacgcaccttctggtccaaatacagcctctacctcgtctccctcattcttacgcagcagaccgtggtccacgaacacgcaggtaagctgtttgccaatagccttggacagcatgacggcagccacagaggaatccacaccgccggacagagcgcacaacaccttaccgttgccaatcttctccctcagagccttgatggtggtatccacaaaggaatccatcttccagtcaccggagcatccgcagacattatatacaaaattggagagcattctggtgccttccttagtgtgaaccacctcaggatgaaactgcaccgcataaaaattcttctccggacactccatgccggctaccgggcaggagtctgtatgtgcagtgatgcggaagcccgccggcacctctgcaatgtacacgccgtggctcatccagcatacggtcttggaagaaacgccctcaaacagcttggaggaagtatccacattcacttctgtgtgtccgtattcgctgaccacagccttctttacaacgccgtccagcaggtagctcataagctgggcaccgtagcagattccaagaaccggtattcccagctcaaatatctcctttgagcagcggggtgccccgtcttcaaacacaacgtcaggtccgcctgtgaaaatgattccctttggattcatttccttgattttctccaggctcatatcataaggatgcacttcacagtatacgctgcattcgcggacacggcgtgcaatcagctggttgtactggccgccaaagtccaatacaataatcatctctctgttcatgagattcgttcctccattattttacggattttcccaccaaaacaattatagtaaaactgtatcccagaacgggtttgaaaataccctgtatccgacgccccacagcagcctgtctgatgaaagctgtgcgtaacccgcctgcttccgctgctgccagtgccaaaggtctaacccgatacaaaccatttccaaacccgcccttattatataccttgacccaatttaccgaaaaatatttattccctataaaattgaaagagattgtacagaatagtacaatctcttttttatctttcgtataaatacattataaagcagagaacgacaaatatcaagctatttcgacacttttttcagaattttttgccggctatttgacgagcatttatattatgattttttgccgagattttttgccggaactctttatcgaaactttttaacagactcccatcctccgccccatcttctgctctgccgcaaaccctttaatcagataacttccttccgcagaatcctcgcaatcctctcctcatccagtccccggattacctccacggccattctgacagtggcgtccacgtcttcttccgcgcagaaattatagtggctgtgtacatacctggacggaatgcctaacaccagtaccgggaccgcctttcccgtgaggctgatttttccggcatttgtgctgccgccccggcgcactgcgtcctggtacttgattccaagcttatctcctgtctcctgggcaaaacgtatgaattccacgttggaaatatagctgttgtccatgtggcgaatctgcacaccgctccttaagcatccctgggcaataccggcacggaaatagaagtcatccgccggtgatccctcaaacacaatggccaaatcaggctgaacctgctgtgccgtcaccgtggcccccctggtacccacttcctcctgggccgcaaatgcgcctaccacttccactgccagctggtccgcctcatcccgaagcgcctgcatggtgtcaataatgctcacacaacccagacggttgtcaaaagccttgccgtacagaattccattttccttatgatactcaaagcttacatccggcataatagggtcgcccgggcggattccatagacctccgtcacttcctcccggctactggcacccacatccaccaggatatcctcgattgccagggagttgtcgtttttctgagccgctgtcagaaaatgaactggtttggatgtggtgattcccctgtgctttttcccgtcccttgtccttacgatgacagagtgggcgggcaggctggtgagatggaatcctcccagcatcagaatacttaaaagtccgttttccagtatggactgtaccatgaatccgcattcgtccagatgggcgtccagcatgagcacggggcgcccggcctttttcttcttcatggtggcgtaaacattgtacatagcatcatttgccacatccaaacccccgcaccagttctttacttcccggatgacctcgtcctcaaatccactgggaccaaaggcattggtcaacgcttcgatttcttttatgtttgccatgatttcctccaggtatgagacgcaaagtgccgcatcacatggtaccgctcctgccataccatgcctgcggcactgcatctgcttaacttatttcttctaaacttatttctgctttattgatttctactctatttatttctgccttacttatttctgccttactaattctgctctgtttatttctgccttacttatttctgccttacttatttctgccttactaattctgctctgtttatttctgccttacttaatctgcctcacttatttctgcctcacctatctctgcccaacctcccctgcctccgcaggaaaagccttacagtgaaaccttcttaagctcctcaatcaaatccagaatatagtcggctgtggtctgtaccatctcctggccccactccacggtggcggtgtttggatgatccggtccaatccatccgttgtctgtcacctttggcgtgttcctgagaatttcaatctcaacacccttgaagcgcacggtacggaagccggtagccaccaggttttcggtgagattggtcatttccagagggaggtcaatcttgctcatatctaccagtgaggggtcaactgccatgatgccagctgtctcctcgccgccgccgtgtccgcccttccactcaggcttcatatcccaggccatcagccaccagttcagcatcacgaccatggcgcccttcttgtcaaattccaggccgatgcgctcaatggtcttgatattccctccgtgtccgttgagcaccagaattttccgcgcgccgtgcttgtacagcccgtccacaatctggtatacatactggtacagtacgtcggaatcaatgttgatggttcccggataatcagccagtgactggcatgctccgtagggaatcatgggcgcgatgaggatgttgtcatttttctcctcaatcagatccaggattttgtcaggtatcagggtgtcggttcccagcggcatatggcgtccatggcactccgtactgccgattggaagaatgaccatgtcattttccttaaaataccgttccgctgttggccatgtaatctttgataatctcatgatgcatctctccttttacttctcttattttgcaacctttacatgctccagcttgtggtagccgattggatccatcacgaaaccttccaccttggcattggcgcctgcggtgatggtgctgtagtagataggtgcgttgttgttcacttcttttaacttcacagccagatcctcatatgctttcagtctcacggactcgtctgcgctggtccttcctgtctcaatgagcttgtctacctcaggatctgcgatgaagctgcggtttccggctgctccctgctgtgaggagtgttccagtgaatagtaggtgtaatctgcgtctgtggtggaggtcacccagccaaagtatcccatgtcatgctcccctgcggaagtcctggaaataaagctgccgaattccattacctcgatgttgcaggtgattcccacatcctgaagcatggcctgtacagcctggcatacctctacacgtgtctggttgtcatttacccagatgctggtctcgaatccgtttggatatccggcctcggccagaagggattttgccttctcagggtcatactcataagagcccgggctgaagtatccgaatacagccggtgcaatgatggcgtcagccggctctccggagccgctggcaatggtgtcgataatcagctggcggtcaatggcgtagttaacggcatctcttaccttctggtcatcatatggcgccttgttcatgttcatggaaatgtagtagcaggtcagggacggagcctcaaacagctggaggtcggaattgctccttaccttctccaggtcgtttggaagcaggtcgtaagccaggtccacttctcctgtctccagggcgatggttctctgggatgcctcagggataaccttcataaccagcttctgtgtctctgccggtcctgcatagtaatcgtcaaagcgctccagggtaacggaatcgccctgcttccactctacaaacttatatgggccggtaccgattggatgaagcttgaaagcttcctcgtccgcttccaccactgcctttggaacaatggctgcaaatggtacggaaaggtttctcagagccggtgcatagggcgccttcagctctacgttaactgtataatcgtctaccacgtccaccttgtcgataaagtcaacaatataggaaaccgcagcggaattaatggccctgtccagggagaactttacatcctctgccttcacctcagaaccgtcgtggaatttcacgccctggcggatgtggaatgtgtaggatgtgtcggaattctgatcccagctctctgcaatctggggctgcagctctccggtcgcagcgtcaacaacagtcagcgtgtcgaagatctggtccgtaacctctacagccggtgtctccttgccctgatgggggtctaaggatgtaacatccgctccctgcgcccataccagcgtatccttgtactcccctgaaccgccggcgcttcctcctgcctctgctcccttggaatccgcctctgtctgagcgctgccgccttccgtggaggtctgtccggacttggaacagccggctgcacttactgccattgctgccactaaggataatgcaatgactttcttccatgtttttctcatactagctcctctctttcttacatttctctctgtcaatattgctctctataaataccggaccacaggcttctgccctggatttctccggaatttaaccctgctcctgaaccatacggcagcttacaaagtgccccggctccatttcctttaaggtcatttcattgctggtgcagccttccgttgcataaggacagcgctttgcgaacctgcatcccggctccgggttaataggcgatgtgagctcgccctttagcggaatgcgctccatcttaaagtccggatcgggaaccggtatggctgacagcagcgcctttgtgtacggatgcatgggattcttaaacagtgccttggcaggtgctgactccaccatctgtcccaggtacatgaccacaatgtcattggaaaagtgccttaccaccgacaaatcgtgtgtaataaacatgtaggtaaggttcagctcctcctgcagatcctgcatcaggttaaggatctgggcctggatggatacgtccagggccgatacaggctcgtcgcatacaatgaacttgggattgaccgccagcgccctggcgattccgattctctggcgcctgccgccgtccagctcatggggatatgtgtttaccagacgcttggccagtcccaccaggttcatgatcttctccacctgctgggtgatggcggccttttcattgggcttgtaaatcccctgcaccagcagcggttcgatgattgcctcgctgaccgtcatcctgggattcagggaggcaaaggggtcctggaatataatctgcatatccttcctcaaatccttgagctgcttcttgttgtagcccaggatatccttgccctcaaaataaaccttgccgcttgtgggttcgtgaagcctcaggatagcccttcccatggtggattttccgcatccggactcccctaccactcccagtgtctccccggtacggatggaaaagtttacatcgtccaccgcgtggagcgtgcccttgggggttgtaaaatattttttcagatgttccacacgtaatatctctgttttctgttcctgcatatgtcaatctccttttcttagcggtagcggatgcagcggacctggtgggttccgcctacagtcaccatccccggatggttcttggaacattcaggaaccgcatacttgcatctctcgcagaaaacgcagccctcaggcagcttggtggggtcgggcatcatgccgtcaatggcctgaagccgcttcacatcgcttgtcaggctgggaatggaaccaaagagtccctctgtgtacgggtgtttcgtgtccttgtatatttcccgcagggttccgtattccaccacttcccccgcatagatgattgccacgtaatcacagttctgggcaaccactcccaggtcgtgggtaatgaggatcatggatgtgttattttcagatttaagcttgtatatcatttccagcacctgggcctgtatggtaacgtccagagccgtggtgggctcatccgcgatgagcagcttggggttgcaggccagggcgattgcaatgaccaccctctgcttcataccgcctgaaaactggtggggatactctccaaaacgctctgccgggattcccaccctttccagcatgttttcagcccattttctggcctcctgcctggacaggctggtgttgtggttctcaattacctccatgatctgctcgcctaccgtgagcaccgggttcagggaggtcatagggtcctggaatatcatggaaatgtccctgccgcgaatggcctccattccattggtggaaagcttcagcaggtcctgtccctcaaaaatcacctctccgcccagaatcttgcccggaggattgggaatcagcctcataattccttttgccagcgtggtctttcccgcaccggtctctcccaccagtccaagggtctctcccacgccgatatgtatattgacgccgtttagcgcctttaccactccgtcatccgtttcatagtggatgaccagatcttttacttccaataatggtttatctgccatgtcatactcgtcctttcttagtgttcatccgtcagctcttcaaacgcgggtcaagggcatctctcagtccgtctcccaccaggttaagggccaggatggtgagcatgattcccatgcccgggatgatggtgacatgccatgcgtcgcggatatagcttcgggcattggacagcattgcgccccactcaggggtgggcggctggatgccgaggcccaggaaggaaagtcctgcgatggaaaggatggctcctgcgattcccagggtcacctgcacgataatgggcgccatggaattgggaatcacgtacttgatgatgatgcgccagtcgctgcacccaatagagcgggccgcttcaataaactcctggtccttcaccgtaagcaccgatgcccggaccgttctggcaaaggtgggcacataggagatggcaatggcaatcagcacattggtgatgctggtccccagggccgccacaatggcgatagccagaagcatggacgggatcgccagaagaatatccatgattctcatgataatattgtcagcggtcttgccgtaatatccggcgaatgctcccaggaggccgccgaagatgcatgaaataacgatggccacggttcccataaacagggagtaacggaccgcccacagcatacgcagcagcatgtccctgccgaactcatccagcccaaaggggtgagccaggcttggtccctgcagacgtcccctcagatcctgctttaccacgtaattcaggtaaatggatttgccggtaaccgcgtcaatgataatggttgctattgctatgatgaccagtgccaggataaaatacatgccaatcatggccagccggttctttttgaatctgcgccatgcctcgccccacagggagcgctggtcgccttccgcttccgcggcaatcagatgtttctttcccatgaactgcacctactttctcttgtattgtgatttaattctcgggtccacaaaggcgtatatgatgtctaccgccaggttgaccacggtaaacatgattgccagaaagataacagaccccaataccatgggaatatcttttgacttgatggaatccaccatgagacgtcccaggcccggccaggaaaatacggtctctgtcagcatggcgcctcccaaaagggtgccgaactgcaggcccactgccgtgataatcggaatcatggcgttcttaagcatgtggcgggtggtgattttcttatcggaaacaccctttgccctggctgtgtctatgtaatcctgacggataacctccagcatggatgatcgtgtcatacgcgtaatcatggcagcagcccctgtgcccagcgtcaccgccggaaggaccaggctcttgatgagaggtatgaatccctcccccattccctgtgaaggcagccagcccagggtcagcgcaaacagaataaccatcagcaggccgaaccagaagttaggcatggccacgccaatcagtgagagcagcatggctgtattatccatcatggaatactgtttctttgcggaaataattcccgttggaattcctatcagaatggccaccagaatacctgccactgccagcaccgctgtgttaggaaaccgctccataacctgtgaccatacgctcaggttatttttataggatgtgcccaggtcgccgtgaagcatgttaatcatataatgaccgtaacggaccagcagagggtcgttgagtcccagctcctccctcttcatggccagcgcctcggctgatgcctggtctcccaggatgattgccgccgggtcgcccggtgacaggttcagaatgaaaaacacaatgaacgtcacgccgataataaccggaatcagcataagcagtctttttaacacatacttgtacatttttctctctccaatcctcgtatatttgctgcattaacgcagcgaagcaaaatacatatttcacaaccccgcacaggggtttgaaaccaaaataataaaaaagaagccttaggatttgaaactccctcgcttcattcaaattataaaacaatatatcaaaattgtcaacaatcattgtttaaattttacactttaaatattttgtcaacatttctattgtgctttttttcaaatctatgatatacttgtctgtatattaaatctaagtgtctctctggggcgcacacgtcttggagccggcacatgtttgggaggtaagaaaatttgaaacagattggcggattttttacatatgaaccactgcccgaaaccgagaaccattatctggaaaacctatgcccgccaggaggaagcctgcgctttttcatgtccggcagatgtgccaactactatgcgctccaggatatctgcctgtccgacacaaaaaaaatggcctatgtgcctgtctacacctgcgagacagtcctggccccttttctgaaagccggctatgaacttttattctacgatgtatccagggatttgacccccatttttgatgaaagggtcctggaccgcatcagcgttgtcaatctctgcggctattacggcttttgcagctacgacagggaatttatacggaagtgctccgaacggggcatcatcattgtggaggatacgacccactccatcttctcagccgacggtgttgaccctcactgcgattatgtggtgggcagcatgcgcaaatggattggagtaccggctggcggattcgctattaagaggaaaggcggcttttcccttcccgttctgcctcctgacgaaacccacctttccatgcgcagtatgtccatgagaggcaaacagcagcttcttcaggcagggactcccgaccccaaggccatgcagaagttcaatgataccttctgggacgccgagatgatgctgcgccgcatctttgattcctatgaaagcgaccgggattcagagtacatcatccggcactatgactttgagcagctgaaacaaagacgccgtgccaattaccagtatcttctggatcatatgccggaacatccccagattaccgtaatattcccggttcttaaagagggcgctgttcccagccactttaccgtgtatgcaaaggacagggacatggtccagtcctatctggccggacaaggcgtcaagaccaccacctattggccccagggccccatggtggacaccgagggccatggcgacgcggactacatttacagccatgtcctgtcctttacctgcgaccagagatatgggactgaggatatggaatatatatgcagacagatagaggggatgcctgaagcgtaagggcttaaacctaacggaagcatatgaacggattgtttggacggatagtatgaacggaaacatacatatatatttaaaaagcggaaatacgggaacgtgatacaatcgtcttcacgtcctgcatttccgcttttccatgtccgcatttattttttgtccctgcatccgcaattacacatgataaaacagttcctggttcttcatcttcattccaatccggtaaattctctcaccgttggctatgtagtgggtattgattgcgctcctggactgttccaggtttccccgctgcaggatttccaaaagccatttatgctccagatagttgtttccccgccgtcctgcctgggcagcaatgtcttcctggtccaaatccacctgtttttcagacacatacccgttaatttgcttgatggtatagaacatggctccgtttaaagggcttaatgtctcccaaagactggtcagacgctccatctggcctgataataaaatctgtctgtggaatatctcatcatactggatgattttccccatgtcgtcctctgccacagcctccttcatggccagcaccgcgtcctccatgagaaaaatgctgtcgctcaggagacggcccccgcaccgctccaaagccaggttttccaggttgccccgcagaaagaatatctcataggcatccttgggtgaaagcatggagacagagtaccctttattggtctcataatccagaaacccttcgtacatcagctgcttcagcgcatcccgcaccggtccccggctcatccccagcgttacagctatatcattttcaaccagcttttctctttgagccagctttccctgaagaatctgctccctcacataatctgctgccacctctgaaagatttcttttttttcccttatccattacaatccccgctcctagcactgctctttaacctgtccattataacgtaggcccggcgcaaatgtcaaaggattttcaatatccgtcatattttcgagattgtccgagctgtaaaaagaccggctgatagaccggttcctgaactgagccggagccgctatggcatcacattccatctccacacaggcacagccctacgccttcctgcgggccgccttatccctggtttccctgtaaattccgtcggttgtccacactttttccactctatacctgattcctgtctttttagaaaaaggcggggataacctcatccccgccgcgctccggccgctcccggccgcatctgctgccataactgtggtcaattcagatatttctttacatacattcccgtataggacaccggacaacaggccacttcctccggtgttcccttggcaatcactgttccgcccttgtccccgccttccggaccaatgtcgatgatataatccgctgtcttgattacatccagattatgctcaataaccacaaccgtgttgcctccctccgacagcctgtgaagtatatcaatcagcttatggacgtctgcgaaatgaagtccggtggtgggctcgtccaggatgtaaatggtctttcccgtgcctctcttagacagctccgtggccagcttgattctctgggcctcgccgccggacagctccgtggacggctgccccagccggatgtatcccagtcccacgtcatacagggtctgtatcttcctggtaacagagggtacattttcaaagaacttaagagcctcctccacggtcatgtttaacacatcgtagatgttctttcccttgtacttcacgtccagggtctcacggttataccgtttgccgccgcatacctcacagggcacatatacatccggcaggaaatgcatctcaatcttgataatgccgtctccgctgcacgcttcacaccggccgccctttacgttaaagctgaaccttcccttgctgtacccctttgccttggcgtccggagtggaggcgaacaggtcccttataaggtcgaacacacctgtgtaggtagccgggttggacctgggggtacgtccgataggcgactggtcgatgtcgataatcttatccagctgctccacgccctcgatgctcttgtgcctgcccggtatggttctggccctgtttaacttccttgccagggatttataaacgatttcattcacaagagaacttttgccggaaccggacacgccggtcacacatgtcatgattcccaggggaatgtccacgttgatgttctttaaattgttctccgcagcgccctttaccgtaatccagcccgtgggctttcttctctcggcaggcaccggaatcttcacgcgcccgcttaagtaagctcctgtaatggagtccgggttcttcatgatttcctcggccgtccccatggcaatgacctttccgccgtgctctcccgcaccgggtccgatgtccacgatgcagtccgctgcccgcatggtgtcctcgtcatgttccaccaccaatacgctgttgcccaaatcccgaagatgggtcagcgtcttaagaagcttgtcattatcccgctgatggagtccgatgctgggctcgtccaggatataggccactcccaccaggccggagcctatctgggtggccaggcggatgcgctgggcctctccgccggacagggttcctgtggcccgggacagggaaagataatccagtcccacgtcaataagaaagcatatcctggccctgatttccttcaaaatagaggcgcctatggtctcctgcataggagtcagcttcagcccgtccatgaattccttaaaccggacaatggacatgttggtggcttcatatatattcatcccgcccactgtaactgcaagggactcctttttaagcctctgccccttacagaccgggcagggtgtaatccgcatataggtctcatattccgccttggacgtttcggaaaaagtctccttgtagcggcggtttacattctcaatcaggccctcaaacgccacgtcatagacgccctcgcccctctggctcttatagcggaccttcacctcccggcctccggttccgtataacagcacatcgtggatttccttggggtaatcctggaagggcgtatccaggctgaaatcatacgcttcggacagcgcttccaggattgcccttgtaaagctgcccttatccgcacaggactgccatcccatgaccacgattgcgccctggtctatagacagggacttatccggaatcatcaggtcctcgtcaaattccatcttatagcccaggccgaaacactccgggcaggctccgaagggattgttgaaggaaaagctccttggctccacctcgtcaatgctgactgcacagtcaggacaggaaaagctctggctgaagttcaccggctcaccgccgctcacatccaccatcatcagtccgccgctcagggccatgactgtctctatggaatccgtaagccttttttcaatgccttcctttacaatcagacggtccaccacgatttcaatgttgtgcttgatgttcttctccagccggatttcctctgagagctcgtagagattgccgtcaatgcggaccctcacataaccgctctttctggcctggtccagcaccttcacatgctcgcccttgcgccctctgaccacaggggccagcagctggattttggtccgttcaggcatggacataatctggtccaccatctggtcaatggtctgtttgtgtatctccttgccgcattttggacagtggggtataccgattctggcatataaaagcctcatgtagtcgtagatttccgtaaccgttcccacagtggaacggggattccggttggtggacttctggtcaatggaaatggccggagacagaccctctatgctctccacatccggcttctccatctgtcccaggaactgcctggcataggaagacagggactccatataacgcctctgcccctcagcataaatggtgtcaaaagccagggatgatttgccagaaccggacagtcccgtaaggaccaccagctcattccttggtatatccacggaaatatccttcagattatgctcattcgccccgcggattttaatgtactgctttgccatcgaacatgctccttgtcttttatcttaattggcttcttgtaaaatgttctttctgcatagcgctgatacacagcgctgacagcctctagtatagcacatcgcctatgtatttgcaaacatttgttcgatgaattgctgcaaaattactggaacctcttccagcagactcctggcgtgaacccgctccgacatctggtgcgcatccttgccgatggggccgaataaaagggaggggaccctgaaatccgccatggcatccaggtccatccggtacatggttccccacagaggggcattgaccgcataggaggccatttcctcccgatccggtcccccgcagtagcttaaatccgatatcccgcagcagtaattgcgctttccaagacagagaccgcaggtgtcctccgccgccttttgcagcaggttatagagacgggtaccctctcctgcctgtatacctccttcctgtatacctccagtccgtcccgccctatctgtctcccccagcctgtcgctgtgaaaggccggataatatggaggcgcaaaagatataaccatgacaggcgaagtgatgcccgaaaacgtcagcatggcatccatcatttccagcgtagcctggggataattcatggcacctgtccgcacgtccgactctatttttccgtaaaggtcctgataccatttcccatatccttttttcttccggcatatctctgccagctccccgtactccagcacgcagtgttccaagtccaccttgggcaggatatttcccgacctgaccagggcttcctggctctccatccgtttcatataggacgcaaaggaccgccggcccatttccttcagccgttccatgacctggctggtggtctttgaaaatcccagcatactcatatatccggctgcccgcagggggacagacacatcatatccgtacttgcggtcccgcagattaaaccaggtgggaggaggacaatgctctccctcaaaggtctcggaaaattcaggggccagttccgtggccataaacatctccgccagcacgccgatggcattcagtccgtgaaagcattccaccacatgcgccttggcgccctgtacaagaacagccggcatggttttgcccacagaccctatatagacctgctgcttgccgccctcattaaagctgggctccaaatccacaagacagtcatatgtaagcccatattcctgccgcagccctgtaaacagggaaacagctcccctcatccccgcagaatatgcctcctcgtccgccaccgccgcaaagagcaggtttccggttgtctcaggatattccagcaccttctgtccaaaccagtccatgatggcaaggccaatggaaagcccgcctttcatgtcgttcactccccggccgaacagccactcccctgacgccaaatcatccctggcctcctggggcagcatggacttaagcgcctccagttcctccccgtggatgtgcttccatgcctccatatcatatgccagggcgcggaaccttccatactcgtccgtgtccaccacgtcgtaatgaccggtaagcacaaccgttccggctcccttccctctcacaaggccgtacacaacggtccgtcccagactgtcgccttccagagcgcactgcccgcagagggacgggtgtttcgcaaaatagggctggcgttccagacatcctgcgatatagtctgaaacctccttctcctgtggggtgttggacacgctgggaatggaaaccatcccccgcaggtaatcatatatctgtttttcaaacaacaaagcaaacgcctcttttcctgaatactgcctttattttatatatgacccagtatattccattcattccgggatatcaatacccattgtataacctgcacaaaaaaccttgtaccaatatggtcgttttaacgaaaacaaaattcctgtattcatttgatttcagatatagcggagggaaaaccattgaaaatcatcagaatcctgaatacaaatgcggtggtgacacaggaccgcaaagaccctcccgcgtcggttagatactgatatctatccgtcctgcgggagggtcttttatcttacttatttatctattttttttacttatctgtttcgttctttgcttctctgtttcctgtactgcatgacgattccttccctggcatccggcctcaattccctaccgttcttccctgaaatacggaagtcccaggctctggggcggctggtattctctcttctttctcaggctggttataaccaggaccacaatggtgaccacgtagggaagggctttgaatatctcctgggcgcccctgtccaggccaggtatatacaggtaaaggatgtacagaccgccaaacaggatagaaccccagatggcattaaccggtttccacagggcgaagatgaccagggcgattgcaagccagcctctgtcgccgaatccgttgttggtccaggtaccgccggagtattccatgacaaagtataatccgcccaggccgctgatgcctcctcccaggcaggtagccagatacttgtaggccgttacattgatgccggccgcatctgccgtggccggactctcgcccacagccctcaggttcagtccccgtctggtcttagccaggaaaaacgccagggccagggccagggcaactgccagataggtcagaaatccgtaggagaaaaaaatctgtccgatgacgccaaacttggacagtccgggaataggagtcttataggcagcgcctgtcactgccacggaaatctgtcccactccccctgccagctttgccagggaaccgccgaagaagttgccgaagccaaccccaaaggtggtaagggcaagacctgtaacgttctggttggcccgcagcgtgatggtcagtacactgtataccagtcctcccagggcagcgcacacaaaggcgcacacaaaggaaatcagaagccccaccagaccgtttggattggctgtcccgttttcatacaggaaagccccgatcagtccggcaatgccgcccatatacatcatgccgggaatacccagattcaggttgcctgatttctccgtcatgatttctcccagggctccgtacaggatgccgataccctggccgattgctttctgaataaatataactaaaaaacccatatttcagcctccttatgacaattttgcccctgcttctttccgtttgctgcggattcccaccttgtagttgatgaagaattcacagcccaggatgaagaagaggatgatgcctgttattacatcagaggcattttcattcaggttaaactgggaggcaatctgcccggctcccttttgcatgaataccaggaaaaacgacaccaggaccatggcaaatgcattgaacttgctgagccaggatacaatgatggccgtgaatcccctgccgcccgccgtgctggtggaaatggtatggctggcgccgctgactatgatgaagcctgcaatgccgcagatggcgccggacagggccatggtgcggataattaccttcttcacattgattccggcgtacctggccgtgttctcgctctctcccactaccgcaatctcatatccctgcttgctgtacttcaggtagatgaagatggccagggtcagcgccagcacgattaccaggttccagccgtactccaggccgaacagcttcggaagccatcccccctttgtggaggagttgatggttcccacggagttggatccctttggattctcccagaaaatgatgcagtatgtgatgacctgcatggccacatagttcatcatcagtgtaaacaatgtctcgttggtgttccagtatgccttgaaaaatgccgggatagctgcccagaccatggctgacagggcgcttcccaaaagcatcagcggaaacagaaccaggggaggcagtgaattgcccaggtaaatcatcatggccgcggatgtgacgccaccaatcagaacctgcccctctgctccgatgttccagaaccgcatcttgaatgcaggtgtgatgccgattgctatacagagtaacaccagagtatcgcgaatggtcatccaggtacgccttttggtacccactgccccgtcaaagattcctttataaacctccaggggattaagccctgtcagggcatagatgacccctgcacagaccaccagcgataagagaaccgctcccagcctgatggcccaggccttccacatatcaatctcatccctcttggatatatgcatcagaggttccttgttggatactgccgtcatctccttactcacttaatccacctcctgtcctggtcatcatcagccccacctgttccttggtcgctgttctgccgtccacaacaccgtttacctgtcccgcgcacagcaccaggatacggtcgcacagctccagaagcacatccagatcctcgcccacgcagataacggcagctccctgtttcttctgttcattgaggagatgatagatggtgtaggatgagttgatatccagtccccgaaccggataggccaccataagcaccttgggattggatgaaatctcccttcccaccagcaccttctggacattgccccctgacagcttgcgcaccggggtggagacgccgggggtcacgatttccagctcctctatgatctgctccgccaggttttttggcgtctttctgtccgtaaagaaggaacgtcccctgcggtagcccctgagcatcatattgtccgtcatgtccattgcgcctaccagtcccatacccagacggtcctccggcacaaaggaaagctttattcccagcttattgatagctgaggcgctcatgccggacagctgcttttcgccgccctccggcggataataagtgatggtgccgtccgtcatggcttccagtccggcaatggactccaaaagctccctctggccgcttcccgcgataccggcaatccccagtatctccccgctgtaagcagtaaaggaggcatggtccagggtggtcactccctccttgtccacgcaggtgacgccttccaccaccagtcggcgctccgggttcacaggttccgggcgctcgatgttcaggcttaccttcttgcccaccatcatctcggtcagggattcctcggtggcgtctgccgtatataccgtaccgatatactggcccttgcgcagtacggacacccggtctgacagcgccagaacctcatggagcttatgggtgataataatgatggaatggcctgcctcacgcatgttgcgcagcactgcaaacagcttgtctgtctcctggggtgtgaggacggctgtgggctcgtccagaatcaggatatccaccccgcggtacagaagctttacgatctccacagtctgcttctgggatacggacatggtgtatatcttctggtccggatccagctcaaacccgtatttggctgtcagctcattgattttggcggacacagccttcatgtccagcacttcccttcctgacagtcccaggataatgttctcagccgctgtcagaacatccaccagcttgaaatgctggtgaatcatgccgatacccagagcaaaggagtccttaggcgaacgaatggtaacctcctttccgtttacgaatatctgcccttcatccgggtagtagataccggaaatcatgttcataagggtggtctttccgcttccgttctcacccaggacggacaggatttccccccttttcacagacaggcataccttgtcgttggcagttaccttgccgaaccgttttgtgatatttttcagttcaattgcgtattcttcgctcacccggccaacctccgttctttgtatttagccttgttgcattgtctcgtggaaaaaagcggagccagatatgaatggctccgcttttacagcctttaatttccagcgggaaattatagcatctgctatcttagttgtcaattgtggtgataccgtcaatcaggatatcaaaggcaggtgcggaaccaaactctgactcatggaaatatccgtcggagatatattcaatgtcgctgccgtccttcttatatgtatccagtgtctcgccgccaacggtccatgtggaggtgtcgaatacatgaagctcgccggatgccagcttggcctctacctcatccaccttctcctttgttccgggtgccacagccgcctcgttcagctctgtaatcagcacagcgccgtcagagaagcccttgcaccagtcaaccggaatctcggttccgtcaatgacatgctgtacagcctcagtcacatatgcggcccagttattggaagcagatgtaagagcctgttttggagcagtggcaatcatggaaatgttgtagcccacgcagggaacgcctgccgcctcacatgcggtaggagcgccggtggtatctgcatgctggctgatcagaacacatccgtcggaaatcagggcgtcagccgcttccttctccaggtcaaagcttgcccagctgttggtgtacttcacttccatggtggcgtccgggcatacggaacgcacgcctaagaagaaggaggtgtatccgctgataacctcagcatatggataagcgcccacataaccaatcttgcatgcatccgccttcacggttccgtcctctatcatctggttcagcttcagtccggccacaacaccggatacgtaacgtgactcgtagatggatgtgaaatagttgtgcatgttgctcaggccgctggaagctgcctggaagccggttgcatgacagaactggacatccggatactcctttgccgcctcaatcacataggactcatgtccaaagctgtttgcaaatataatctggcatccctggtccgcaaggtccatggccgcatcctttgcagtctcatcctccgggatgttccacttaacgataatctggtcatcgttcaggcccagtttttccttcatctccatggcgccgttgtaatgagcggctgtgtagccctcgttctcatcgcctatgtagacaaagccaatctttaaatcttccttggcaatgccgcctgcggccggtgcctctgaagcctcggtctccttggtctctgcatcctctgctgccgcagttgtctcagcctcagctgctgtggttgcgtctgccgcggttgtctttgctgtgtcagatccgccgcaggctgccagtgatactgccatcacgcctgccatggccacgcttgctaacttttttaatttcataatactctcctccatgaagtgtaagtttgcagaacccgattaaaatacgtcaggtactggctgctccattacacctgacgttccatcgttgtcctacccattaaaaagtaacacaaataccagttaagtatatctactttttttcctattgtcaatattaaccaggaaaatcgacccatttttacacaataagacaggattgcttttatttatcagcaatcccgcctttcattcttaagccatgcttataatttagtttctttcagctgcattttcataaaatacttcgcacataacacctgcaccgatgcggaacccatctgtaaaacactgggtcttctcaatgaaggtaagctccaggtaatgttccatcagaaggtcgaattcctccttcatgtccctgtccagcttgtcggtaaaccggttgaagtcgtccatggactgcctggtcagtgcatcgtattccgcgttgccgcgtatggtattttccgccgggcataagtcccccctgtacaactgctgcaaaatctttcccatacctttttcctgcctttcttttgtcaaattattttcacagaaaggcgggggccgtcacgccgcattctccatccgctctcaactcattctctcatcaaccaatcatcttctctcatcatctataaaggatatacgcagcgcagggctagggctcccccacctgtctatatatccagaatagcacagcccgtggtcaaatgcaactaaacatatcctattcaccccggacctgctcttcttctgcgcggttgaagatttccatgaattcgtctcctgtaatggtctccttttccagcagataggcggctatctcatggagcctgccttcattttccctgagaatagaaagagccttcttatgctgctccttcacaatggacaccacctgttcatctatgcgctttgccgtgtcaggagcgcaaatcagtgacgtgtctccccccagatactggttgttcacggtttccatggctaccatgtcaaactcatcggtcatgccgaaccgggtcaccatggaacgggcaatcttggtagcctgctcaatgtcgttggacgcgcctgtggtgatggaatggaaaatcagctcctccgccgcccggccgcctgtaaaggtggcaatcttatccagtgcctcctcccggctcataaggtagcgctctccctgttccacctgcatggtatatcccaatgcccccgatgtcctgggtataatggtaatcttctgaaccggggcgctgtggctctggcaggcagccaccagagcatggcccacctcatggtacgccacgattctgcgctccttctgggaaataaccgcatttttcttctggtatccggcaatgaccgtctccacgctttcctccaggtcggcctgcaccacggcgctgcggcccatacgcactgcccgcagggctgcctcattgatgatattggccagctccgcgccgctggcgcctgccgtagccctggcaatggcattgtaatccacgtcatccgacatcttcacgttttgtccgtgaacctttaagatagcctcacgtccctttaagtcaggcagctccaccggcactctgcggtcaaagcggccgggacgcagcagggccttgtccagggactccggacggttggtggcagccaggatgactacgcccttctttccgtcgaaaccatccatttccgtcagcagctggttcagggtctgctcacgctcatcgtttccgctcatgcctccgccgtcgcgcttcttgccgatggtgtcaatctcatcaataaatacaatacacggcgccttatcattggcctgcttaaacagatccctgaccttggcagcgcccatacccacaaacatctccacaaattcagaaccggatatggagaagaaggggacgtgggcttctcctgccaccgcccttgcaagaagcgtcttgccggttccgggagggcccaccagcagcgctccctttggaagatttgctcctatatccgcatacttctgcggattgtgaaggaaatccacgatttcctttaaggcatccttggcctcctcctcacctgccacatcggcaaaggtgattcctgtctcattctctgcgtatatctttgcattggactttccgaaggtcatggcattgctgccgcccatgcgcttggaaagcatgcgccccataatatttccaatgaccacaaacatgagaatgggtgcaacccaggacatcagaaagcttaagagcggagaagcctttgtctggatttctcctgtaaaattctccacatccgcattctgcagccgcttaaccaggtcgtctcccggaatcggtcctgtcttatagctgacattccactgcttctggtcctttttcgtaaactgaatctgtgattccccgttgctgacgtacacatcctttacattaccggcgtccagttccttcaggaactcgctgtacggcacttccacggaatgctccatcatgggaaatacaagggcatttaacaccatcactgccaatatgaccaggaaataatagtaaatgaacggctttttaggcgtgccgctttttaagtttctctttccgctgtcttcattcgcacccataccaggtctccttttcttaattcatactcataggccgggatacacgcagcctgattccagctgcatccgcttcccgctgttcaccatgtaagataataccatttgcaacttttgtcaatggttgattgtaagtttttatttacttttaatatttattgactttttacaccagatatgataaaacgattacagaatagagcgaggaggtaatcggcatgaaccgtgaaccagcagacagcagacatgtgggggaacatttcatggaatttgccattgatttttttaatctggcaaagaacagctaccaccagcagaaccagatacgggcgaattccgctgctttccaggtcctgatgcagttaaaccagccaggcagacaggcgcccaccatgtcggagatggccctgcagctgggcattaccaaacagcagctgacaaagcttatcaatgatctggaagaaaagaacctggtccgcagacagcacagctccaggaaccggcgccatgtatatctgatgattacaccggaaggcgcatccatcatgaagcagctgcgggaagccatgctggagtgcacggtgtcccgcctttcctcgtataatcaggaggagctggcggagctggacgactgcctgatacgtttaagctccttgttggagaaattcggggccgcggaggatatagcatcctgcggggattttcctgagttgtagggaatgggggagaggtatggggagaggtacgcggacgcgtgtggtgattcgcgtccgtgagaggcgggaacgcggggcaaaagatgaccgtttccgcagtgggagagactaaggcgcaagggacaggaaaacccggggaccgcaaaaattacgccggactcctgatgagtccggctccatgtttgctttgcttcgggcgttgagcgccctgcgcaaccccggcttttcctgtcccttccgcctaagtctctccgaactgctccaaagccacctcctgccccgcgttcccgcctctcacccactgcattcttgcggcgtccgctgtgtattccccgcagcgaaaaaaataatatccccgctaatgatattggacaattggcggactttttgcccgcttagattgtatcctttataattaatcctaaactaaaaggccgcatatcaagatgatatcaagataatgcggtcctctttataaatggtatgccatctaccccggcatgccatttttcttctgatttggatataaacgatggaggtgcaatgatacgcagcgggccctgcggttagatccgctggcgtggatagcaggtgctgcatggtgcatcctcatccctctttacaacaccttacttaagaaggacttcagacgctcatttttagggttggagaagaattcctccggtgcggcttcctccataaagtgcccctcgtccatgaacataaccctggtggctacctctctggcaaagcccatctcatgtgtcaccaccaccatggtcatcttttccctggcaaggtcgcgcataacgcttaatacctctcctaccatctccgggtccagggcggaggtgggctcgtcgaacagcatcacatccggcttcatgcacagagcccggacaatggcaatacgctgtttctgaccgcctgaaagctggctgggatatgcgtgggccctgtctgccagtcccacacgctccagtagctccatggcctcatcctcggcttccttttgtccctttccctgaagctttatgggagcaatggtcaggttcttcatgatgtccatgtggggaaatagattaaactgctggaataccatccccattttctggcggtgcttgtcaatatctgtcttagggtccgtgatgtcggtgccctcaaagaaaatgtgcccgcttgtaggctcctccagcaggttcagacatctgaggaaggtgcttttgccggaaccggaaggccctaccacaaagaccacatcccccttgtggatatccaccgtgattccctttaagacatcaatggagccaaagctctttcccaggtcctgcacccggattaagggctgtccgttaaacattcctgtattaccgctcattctgtctcagcctcctttccagtatctgtatcagctttgtaaatatcattacaatgatgagataaataacggcaaccgcaatcagcggcataaatgcactgtatgtcctgcttcggatgatgtccccgcccttggtcaaatcctggatagcaatgtagccggataccgaagtctcctttaacagggagataaactcgttgcacagggttgggagtactgtcttaaatgcctggggcatgatgatgtaccacatggtctgggcatagttgaagcccaggctgcggcctgcctccatctgtcccggatcaatggacatgatgccgcttctgaatatctccgccacataggctcccgagttgactccgaaggccaggatggccactatgaccttgtctaccctgacgcttccgaatacaacaaagtaaatgattaacagctgcaccaccacaggggtgccccggattacggtcaggtacactttacagattgcattgagcaccttaagcttatgggtcttctcataggtggatcgtatcattcccaccagaaatcccagcacaatgcccataaggcaggcaaaaaaggtaataatcaacgttgttttcagaccctcggtcagatatttccaccggttgtccgacacaaagttcaggtaaaacgcatctgtaaatgtcttccacatgctcatcatcctctgctctttctttatgattcataaggcagggcagacgccctgtttttcctctgtcatacagtcaaaaactgccgccctgcaggaacggggatgcggtgcagtattgcacctccctttctgcagcctgcggcagttttataccggccgtcttcctgtatatgccggtactgtcatgtctgtcttaagtgggcgattccatacccggtacgattactcagccttgatatacttggctacgatttcgtccagggtgccgttgtccttcagggtcttaagagcgccgttgattttctccagcagctctgtgttgcccttctttacagcaatggcatactcttcatcggtaaaggactcctccagaatcttcagtccttctgtctcagcaacaaaggtcttggcaggctccccgtcgattacaaccgcgtcaatcttgccctggctcagtgcctgaacagcctcaaagcccttgctgtaacgctctaccgtggttccgtcagcttccaggtcagatacatagatatcgcctgtggttcccagctgcacgcctacgattacaccctttaagtcatcaggagaggcaatctcgctgtcctctgtaacgatgattttctgggatgcctttgcataagtatcggaaaaatctacggactgcatacggtcttccgtaacagtcatgccggccagacccatatcagccttaccggatacaatctcaggaataatagaatcaaacgcaatgtcctcaatctccagctccatgcccagctcatcggcaatggcctttgcaatttccgcgtcaataccaacaatggcatctccgtcatgatactcgtaaggagggaactctgcgttggttgccataacaagcttgccgcctgctgcttccttggctgcctcagtctcagccgcctctgcgctggtctcatccttgctctcggctgccgtggtatcctctgccttctcctctgctgttgtggctgctgctgttgtctcttttgcaccgccgccgcaggctgtcagggaagctgccatcagtgccgccatggtgatcgctaaaaccttcttcttcataataatattctcctcttttcttttatgcatcaaattgcataactataaatgtattcaacattttatattataatgcatttttctggtttagcaagaggaaaatacgggaatcaccaaagaatcagcaaagatgccgtctaattccctctctgtctccggcctgcaagcacaagatgcttggccagcacggccgttgtcaccgccccgacgcctcccggcacaggcgttgccatggatgcaagaggctctatggacgggaaatccacatctccgcataattttccattttcatccacattaatacccacatcaatgactatggcatcctgtcccacgtgacggccgtccagcattttagcctttcctgctgcggccaccaggatttcagctctgcggcactctgtctccagatccctggtcctggtgtggcagatggtgaccgtggcattttccttcagcatcagcatggacagcggacggcccaccaccatgctgcggcccacgatagtcacgttctttcctgttatatctatctcattggccttaagtacctctatgaccgcctctgcggtacagggcgcaaaaccggttttgtcccctgcaaataccttggcaatattggccggggaaatcccgtccaggtccttttccgggtcaatcatcttctcgatgtccgtctccgcaatctgctttggcagcggacggagcaggaggattcccgatacatccgggtcacggttaatggcactgaattcagccttgaaatcgctgtcgcttatctgttccgggaacacatatgtctggacccgcaggccgaagttctccatcttcttcacagccccccgttcgtaggacatatcgtccggtttttcccccacccgcacaatggccagcttcggagccgggccttccagaccttccatcatctgtgttacctgttccttgatttttgccgaaacctcggcgccttttaatattttcattttccttctcctctctgcctgacgccttctacctcagctgttcaagcaccttctgatatatgcggtccgctgcctctgtcccctccttaatcagacgctccgccttctcattcatttcttctgccttctccctgttcttcatggacttggtattgatgtacacattcatcaccgcgcctaacagcgcggtgcggatgaactggactcccacgcccacgtcgctgacagccatcctgcttcccttatccgcaaggatatccatgatttccagcatttccgatgccttttccatgatttccattggcacaagactggcatccaacagccgtgcttccatgacctctgccttgtatgccttttcttcctctgtacctgagggaaggctgtagcatttagccagaggcgcaaatacctttgcatcctggtcggccagcgcggtaaactgtctctggattcccttcatcctctctgccagttccttaatctcatcctccacctgcgcgtatttcttcttgcctatggtcagattggccaccatctgtcccagggcattgcccagggctccggccagggcagaagcgccgcctcctcccggcaccggctcctttgaagataatacatccagaaactcctgaatcgtcatgctctctaccattgtaacatcctcctgtttttctatatatagtttatattatataacccatttacacaattttaactcccatcagcctggccagctcggcggcctgcagcaggctgacctttacacccgccagttccgtgaactgatctgagaccatgatgccgtcaatgacgcactctgataaatccattccctttaacggtgtacggaaaaaatccgtgccggccaggtccgtggaggaaaaaaccgtctttttaaattttacctcagacatgaaggattccctgaaattacagccccttatttcgccgaactcccagaaggcagtagagaaattcccgtagtggaactgactgtccagaagcttcacccacttaaacgtggagttgcagaactggcttccgtccccctttgagtctgatacattcacattcttccaataggtatcccggaaggagcagttagaaaaatcacacttgtcaaatactacattgcagaaagacgcgccgctgaaatcacactcctccatcctgcacctgacgaatttcaccgtgtcaaactccactttttttcccgatatcccaacgaccgtctggtcttcataaaccttatccaaaatcggacattcctgattggctgcttccgccatatcctctgacagcatatctcctccatggtgattttattttgcccattccctgcactgttttaaccttggctctgcatcaaagcccatatctgttcccatggacgcctccatctcacatggaaaatcaggacattctccgcagtggttcagcccttttgcctcgcagcaggatttaacaccgcactcaccgccccagaagggcttttccatggttgcgcatcccgtacagcggaccgcttcccttctttcacattgattgcagcagactccgcatcttgactcaaacatattcttcctcctttgtcacagccccctaaacctgttctttccctgacatctgttccacatccaggcgcagcacagcggttctcttaagcatagcttccgggtaatcccagctgtcctttcctgacatgtggcccatgatgcagttcaggccctttttcttttcctgtgtctcctccactacccggatgggtccttcccccaccacgcttcggtaccggaaggaatatccgcaggcctggtccgccgtcttaaggccatgggcagtgtccatttcaaaccctgcgtacccggtctgcctgaccagatccatcttcttcccctcggcagccccgtggaaatagagcacattttcctcctcgtcgtatccgaagctgagaggtacaatgtaggcgctctttccatctggaaaagccagcctgcagcagtcgcactcccgtataatttcccttattccatatgtatccttaacttccctgtccttccttctcaccatattctccttatccgtgttctattccggcaaagcggtttcccggtgccgccatggttttgccataatgttgccatggttcccccacagcgccgccatggttccgtcacagttcaatatatgccctgcttccgcctgtcttgtccttcaccacaacaatctggtgctggattcgttccttcagctctcccacatgggaaataatgcccaccagacgccttccctctgccaggtctcccagggacttcatggccagattcagagtatcctcatccagggacccgaatccttcatccacaaagagggtgtccagacggattccgcctgctgccgactgtatctcgtccgacaggcccagggccagggaaagggatgcctggaaggattccccgccggacaatgtctttacgctgcgctccgtgccattgtaatggtcgatgacatttaaccccagtccgttcttccccctgttatcctcctccgtacaccgtttcagctcatactgaccgccgctcatgaccatgaacctggtatttgccctggcaatgatacgctcaaaatatgccatctgcgcatacgtttccagagtgattttttcctttccccccacttcacctgccgctgtatcggaaagtgccttgacccatgtccattccttttgtatctcttccatagacgccttctgttccgaaatacgttcccttgccatgcggttggtttccagtctgtggtggagcctgcttttctcctgctccaggccggtcagcctctcccttgcctcagactggtgctgccggttctcctgcatccgcgcctccaggtgttccatggcagttctaacgtccatgccgcccggaagcattgtgtccggcccttttgccggatcccggtcctctcccgcagtctctcttccctctgcgtccttctccgccatccggcccctcagcgcctccaatcgggcctgagcgtccgacaccctgcggcttatccggttataggattcttccgcctccttaaacgccttttccagtccggccagaaatgccttcttctctgccagctccgcctgggcggccttcctgttctcatagggcagggaggactccatctccttaaggcggctttccagttccctttcctttgcctggctctctgccagcattttctgggcctgctgtttccgctccgaggcttcttccagggattgacgccccaaagcccttctgccttcgacggcttccttatcttcctttctcttcttcttttcccgaatcttctccttctgggcagcggcctggcgctccagctgaccttttagctgccccatcatcagctcccactgttcaaggaaatacctgcgcccctgccgtacatcccctgtctttgcagccaacgccccggcatcggcttccgcctggcgaatccgtttctgccagtcctccttccaggtagccacctcagcatcaatctgctgtttcatcctttcatagcgggtatccagactgcctgccagtcttcctgcctccaggctcagcctggcagccgccttatccttttcctcggcagcagccttaagccggtctaccttgtccttggctgcctcgtttccctcctccagataccgtgctggcgccggatgagtgacggagccgcatacaggacagggctggccttctgtgagccgtgaagccaggattcccgcctggttgtccaggaatctctggtacatctcccggtaggcatcgtctgccctgcggctctcctcgcctgctgccctgtaacgctctctggctgcctccagcttcttcctctcctgcccgtactgcgccagctcctctgccagaagtccgatgcgcccgctgtattcgcccagtctctcccctgctgtcagggctgcctggtattcttctcctgcctggcgaaggctttccagtatcttctcatcgctgtcatttcgttccttccactgcctttcctccagggcagcctgccccagccttttttcaaggctctccgtctctttcctgcatgccttcagattttcctgcagcgcgtcaaaacggtcataggttttcaggttttcttccatcctggtaacagcgccaatcagcccgtctctgtcagcctggcgttccttctccctctcatacctgacctttgcccgttccagaaccggcatattttccctgaacacatccgcggcagccgccatatcccggcagaccgcggcatccccctgcattttccccagctccattccaagggcagccatctcatccctgaccagggccatggctctgtccttcccctgctgctgcgcctcatccgccccaatcagctggtccagcacctccaaaagagcttccaggctcccctggggcacctccttccagcgcagcttaagttcctcactatagccctctgtgataacacctccggcatactgttccatgctctttctgctgtccgcgtagcggccatacagaccctttgcccggtccttcagcttttcctgaaacaactggtagggctttgtcttgaatatttcccggaaaatgatgccccgatcctcggttctgcctgacaggagcctggaaaaactgccctgggccagcatggcaatctgggaaaactgctccctgttaaggcccagaagcccttccacctccgccgttaccgctttgtcccctgtaacgagcctgccgtccggcatatgaagctgtgcgtccggcttctcccgtgtctccccttcacctctttgctttgtcctcatatactcaggattgcgccgcaccctgtatccctttccattataggaaaattccatctccacataggtcctggcatccggcctggcatatttgctgcgcagcatcctgggtttgcggctgtccccgctggcattgccgtaaagggcaaatgcaatggcgtcaaacagagtggtctttcctgctccggtgtcgcccgtaatgagataaagtccccggtcccccagggaggccatatccagggtgacctcacctgcatatggtccaaatgcggatattatcagttctgtgggcctcatctgcttccctcccatatctcttccatcagttttaccgcaaagtcagcctgctgctctgtcatgggctgattgttctgaagctggtacagctcctccatcagaacaatgggaggcttgtccgcattggcggcagcttccaccaccctgccctccctggtgcgcttgttatcataatccagcttcatgacattgggataaatggagcgcagcttgcctattgcatccagtatatcctcctcatccgtaagggttatgtgaaggtaatcatccacagccgtacccatgtaaaaatcacggctggtcagttcttcatagcttcctctcagctcccgcatatcatggaggggcctgagaatacgggtattcacggtcacattccccttttccagcagctccaccacggtcactgacttcctgtggttcacctctgagaatgaatatttaaggggagtcccgctatagcgcagggtatcccttcccaccttctggggcccgtggatatgtcccatggccacataatcgaaggaatcgaacagttcagcgctcacctggtccaggccgcctatggacagctcctccgagtcacagcaggacgcaccggtgacaaactggtgggcgatcaggatattgcggtcatcttcccctatcttatgtcccgtcatatgctccagagcccagcggaccgcatcttcaaaggtttcaatgccttcctccgggcagcatcttctcacgacagcaggttttataaagggcagcatatagacccgcaggcttccgtaccggtcctccagttgaaccggctccagatgaccgtcatacacaggcgccatataaactctcctgtccttcataagctgccctccaaaggccagccgctccgggctgtcatggttcccgctgataacaaacacgggcaggttccggtccgccagcccggtcaggaaagcgtcaaagacctgtactgcctcagcaggaggcacaggtttatcataaacatccccagctatgagaacaccgtcaggcatttcctcctccgcaatcatgagaatctggtctaatatatatttttgatcctccagcatggaaaaaccattgacccgttttccgatatgaaggtctgataaatgaataaatttcatagttcttcctttcatgtgcatctttaaccataataccacgagccgggcaccatttacaagaccatacggcccgtccttttccatgaggaccgccttattgaactatgaggaccgccttattgaaagattggactggacctccgcctttcaaatatggtaaactatagcgtaaattcctgtttggaggtgagcatatgaatccaatgaatcttcttcagttaaaaccggcctggaaccagtttaaggccaaccatcccaaaatgctgtcatttgtgaaagccgcatccagggacggggtcatggacgaggggaccctgattgaaattaccgtcacatccagcaccggccagaccattgcttccaacatccgggtcaaaaaatccgacctggaattcttaggagcacttaaggatgcgctggaagattagatgcaaagggcgcccgccctgccttgcggcaggaggacgccctgttgattaatgggatattttgttcttcttcaccgtgtgtccagacattgcatgttcagacacgctctagttcaggttaatacctgtaatggctgcctgtccatccacattgttgaaaataatgctgttttccccgcccatgatgactccggcgccaaactgctccagcgtgtctacatccgtgtcagcaatttcctttaacagactctcagtaaaaatcttgtccgcatccatttttaagaaagctgcctcgtcggcaatctcctcaccctgtccttctccaagggaaacatagaccgggtaagcgcacaggcctgccaatgcctccatatccttatctgccaccgccttctgcaccttctctgcgaaaggcttaatctcactctgttccagctctgccccggcatgggacacatcctctgcctcctccaggagtgcggcctcctgggaggcggattcggatgactgggattctgctgctgtttcagagtccgaagcagtgtctgcctctgtctccccatccgtcaccccgtctgtggtgtcggactgtgttaccacctctgccgctgtagtggtcttggcatccttgcctgagcaggctgtgatggctgccgccgccataatggctgttcctaaaactgctaattttcttttcataattacgtctcctcatctatctgattttcagtatcatattctttatgtataagctgcatttccagagtccggtatgtgcatgcacccctgtgaaatacgcatttcatccaccgcgtccggtgatacactctaacataaagagcctggctccttttgtcaaggcagccaggccaacattaatggttccgtaattaaacttaaaaaactgtttcaatccttttcctaaaatttcataatttaccatgcaacttttttggatttctttcattttgaaaccgtccattgagggctgttcattgcaggcacttcattgtaaacaattcattccctgacgagggcaggacaaccgcctgccggtccgtcagcttctcagtgtggcccgcagccggtccggtttcagcagaaggtccagcccgtcctcaatggagcgaaccaccacagatgcatggcttaacagagcggcgcacatgccttcccgctccagtaccgctatggacagccgggccgcgtcaaacatcggtatatcattaaagccgttgccaagacaggccacgcctccctcaagcccctttacgatttcttccttgcatccggcagcaccctcccgcggaaaggtccttacagttatgcccaaaggttcgcactggcgcgtcaccgtgccgtaggtatcggcagtgagcacatacacataggccagctctttaagccgggcaatacgctccttgacccccttcagcagcatgccgtccactgccgctgtcccgttgtaatccaggaccacatggttgattttcaaaggctcccgcccgggtatctctattacaatcacagtctgtctcctccctgtatctcctgtcctgtatcttctatcccgtatcacttatccccatatccctgccggcccgaatccgtctatccgcagattccggcccaaatccgtctatccgtagattccggccagaaacgcccttgtctcctcttgcgccgggcacccgaacaattggtccgattctccccactccaccagacgcccccctaaaagaaaggccccatagtcagatatcctgcgggcctgggctatgttatgggtgacaatgacaatggtatactgcttcttaagttctgtgagcatttcctcgatcacggcagatgatttcacatccagggcagaacagggctcatccagcaatagcacttccgggtccactgtcagggcacgggcgatacagagcctctgctgctgccctcccgagagcttcagagcattcctgcccaaatcctccctgacctcgtcgtacagtccggccatccggagtttttccttcaccagcgcttccagggaagccttatcccggatgccgtaataccggggcgcatatgtcatgttcttatagatggaaaatggaaagggagccggcgtctgaaacaccagacccacacggcggcgaagcacatccttctgcatggattttatctcctgtccgtccaacaaaatccttcctgatacggatacacccttttcctctgccagcaatccgttcatacaccgcagcagcgtggtttttccgcacccggacggaccgatgacggccgtaatccggcgggccggtatgtctaaggacaaatcagacaatacctccctgccgtcataggatgcgctgacattgtgaagcgtcatgatatgttccattttttctggctcctccttgcgtaaattgttgccaaaaggctgctgaataaactcagcgccatcatgacaaaagcagtcccgtaagccgcgtccatggaagtggctccctgggctaccagcaggtaaagatgcatgggcagggccatggccggagcggagagccgggccgggaggccggaatacgccactgcccccgtgaatatgagaggggccgtggcccccatggcgtagcagcctcccagtatcacacccgacacgatctctcccttgcaggccggcagcacaatcttcctgatggtgtaaaacctggaacagcccagggcataggaggactgtaccagctgttttggcagctccctgaaggtcttctctgccctgacctctataaaaggaagaatcatcacggccagagccgcaccagaggacaggatgcagcgcccccaggccaggtcccgcaccaggaagctgtaagcaaacagtcccaggacaatggacgggattcccgaaatacactggattaccatgcggattaatcccgccatcctgcgtcctttgcagtaaaacaccataaagagtgctgtggcaacagcagggattcctcccaggacaatggctgtcgccgtaaagcagaggctccccacaatggcaggccagattccgccttcctcccccagtaccgctcccctgggcggctgggacaaaaattcccagctgatggtgcctgccccccggtaaaaaacatatccgaacaggaacaatatgatgcctgtcaccaataacatactggaatacgcccagaattttgtaagtgatgcgcgcagatgcatggttttccctcctttatgcctgttccgtcctattgccccggcttatggttccggcctattgctccagtttacttcgcagcagggtgatgccggaattgataaggaacaataaaagcatcaataccatccccgccgcgtacagggcgtggtagtgggtgcttcccaccaccgctgttcccatctccagcgcaatcacagcggcaatgctttcactcttgcccagcagggagggaaacaggtttgcatttccaatgaccatcatcactgccatggtttcccccatggcccggccgatggccagaatcatggacagcagtatgttcttccacgacccaggaaggacaatggtggccaccatatgccacttggagatacccagggcatctgctgcgggctgataccgttctctcaccttcagcatggtctcactgcaggaggatatcagaaatggaagcagcataacggccaacaggattccggccgccagcacgcaggagcctgtgtggactccggccctgatgaaaagcctgaccataagggtcagccccatgaagccatatatcacggatgggattcctgctaaaaggtccacaaagggatataggattccccgcatccgctgggtggcaacacaggaaagataaatggcggcccccaaccccactgtcacagccaggaccattgccaccagagatacatagagcgtagccactatgaaattaaaaatgccaaaagacggctcccctgtgtaagcaataggcatccatctccggcccaacaggaaatcaggcactgccacttcatcgaacgtgggcagtgcctccttgacaataaagtatatgacaaaggccaggaccatcacggtcagggcggtcagggcctttatcagaactgaaaataatgcattcagctgtttattcattggtttgactccatttcaggggattctttcaagggaatatttccctgacaatctccccggcgttttcccggcgcagattaagcctcaggtgtaaaggcaggtatgtatccgttggcctccaccacgtcatatcctgtctgtgagaaaatgtagtcaataaatgcctgctcagacggggtaatctctgcaccggtaacaaacataaccggtctctggatggtatacgcaccgcttataatgttttcagccgtggcttccaccccgtccaccttcatggcagtcagtacctgtccgtctgcgttggccttattataagcgccgaatcccgcataaccgattccccatttgtctccggcaatgttggtggccagctctgtcatggacgctgactgggttgcggacgcagtcacctcgctgtcacccataacactcttctggaacacttcataagcgccgccggataaatcacggatatagacattgatggcctcagccggcagcgtggagtccacctggtcccaggtagcaatctcacctgcaaaaatctggcggatggtctcaacaggcatgtcgtccatgatgccgcagattggattctcagcattgaccgatacggtaagggcatcctttgccaccacgaaatcctggtaatgctctcccagggcttcaatctcagagtccttgatatccctggccagcataccgaaatcagctgtcccgtcaatggcagcgcttacgcccacaccggaaccgcccggtgccacgtaaacagagatattggaatccggaaacgatgaatccaccgcatcccaggtcacatacttctcagtaaaggatgatgccagggatgacagaatcggatacagggatgtggaaccgcagaacaggatggatgactggaactgtgcggaagctgccccgtctgtttttgccgcggcctctgtattctctgcctcttttccggcagtctccttctcagacgccgcttcactggctgcagctgttgttgtctcagttgatgccgcattagagccgcaggcagtcagaaggctggctgccattgccatggatgtaactactgctataaactttttcatattttcctcccattgtcataaattccatatttgtacattttttgcaagtcaagaatagcacatatgacaaaggggctcaaattcaatttttctatgcgtttccagtctgttattgctattttctatgacacggcgctgccaagggacggcccccaaaagacaccggctgccccacaggactgccgcagataaaagccgccattcctacagcagagccctcaccaccgcctctgcggaccgttcctccacctgaatggtaagattggcttcattgatatgctccagataatgggcatccgaattgctgataatcctgcactgctccagatacggattatcacgcttcagctgatgcagtttcttcaggtccctgacctccgctgtcttaaaacagctgtccggaggtataaagcccagatttgcaatcaggctgttggctgccttatccacatgggccggaaacatgacgccgtcataggagcggaccaaagtccacagactgtcaaaggatatttccgttgcgttaatcagcaaattgggttctgaggcgcacacctggtccctgtcatcgtaaatctgctgttttccgaatatctcttccctgttaggaaatttaatcagtttaccataaacataggcatcaaaatcaagtgccttctccaacgtagggaaaaggcacactgcatggacttcctcggacgtattgatttccatgccgggcactgccagcacgccgtactctgcggccgcggccatgaaagccggacagttgcggcatgtgttatggtctgtaagggccaccacgtccaatccttttagagccgccatacccgcaatgttggcaggcgtcatatcatcatccccgcagggcgacaggcaggaatggatatgcaggtcataagccaggttcatcatgacagcataccatgaatcttaagggccgcttcaaagacaggcatatctgtggacagcacggttatctcctggtcaagggccttcttcctggcggcgtcatccagaaccgcgccttccgccagaataacacaggccgtatctgtcagggctgccaccgccagtgtattcatgttggccatgacggtcacccacgcgcagcccgccggggcgcggcccatggcaatgctcagcaggtcgcagcaaaacggaaccgtaatctgccggtccaggctgtcacccaggttcaccacgccgaatatctgtttgtcaatcaattcctgaactgtcataacatcctcctctgctctcaaagcgtcgttatttccggaactccggccggcggcgctttcactcttcatcctcatccttcttatccagcacggacatctcgtccgagattctctgtatgtatcccttcagaatgcgcagcgtctcctggcctcctctgtctccgttatgcaggtcgtctgccagcacagccacttcctcggacagcttgtggagattttcccgcaggtagtaaacacagtccgtctcattggcgtcccccctgacaatatcctctgccagggccttacaggtaggcgctccgcaggaaccgcagtccagccccggaaactttttcatgaggcgctccacctggttcagcctggaaaagctctccatcatattattgcccaggcggaaaaccggctcatactggacgccggtggtccatctgattacattctcttcgctctcatgcatgtggctcctggccacaggcatgtatttgcgcaggcgtttcagcttgacctctgccacatagggattttccacagtcaggacaccgcccacacatccgccgttgcaggcgttcagctccacaaaccggagattggtaaacttctggtcctccatgtcctccagcacgcgaatcacattctcaatgccgtccgctgccaggtaattttccgtaaaaaggccgctggcctctcctccgctgtgtccccagctgattccaattttccccgatgtaccgatgacaggataatcctctcccaccacggtcttcatacaggccagcagcttgggatacacgtccttgatggccagcacctggtcaatctcgctcttttctgttcccagaggcgactttacataggtcactttggagggacagggggaaataaacataataccaatctcttccctcggaagccccgtgtcctccatggcctttctgacagccagaacagcagccacctccaccggcggattgatgggaaggagatggggaatcagattcgggaaacggacccggatcagacgcaccacagacggacatgccgtactgatgagaggcagctgttcctcatgctccgatatgtactgcctggtagcctcgctgacaagctccgcggcggcgctgacctcaaacacatcgtcaaagcccataagcagcagcgcgttaagcacaatgttcacatcatccagattattaaactggctgtacaaggacggggccggaagcgccaccgtatatttatacttcttcatcacatccagcttatcataggtcgcaagctttgcatggtgggggcaaaccctgatgcactcaccgcagtcaatgcagaatttgttattgatactggctttgccgccccgcacccggatggcctccgtaggacatcgcttgatacagttgatgcagcccttgcacagggattcatccagccttacggaatgataaaatttatccattttaccacctcattctttcattctcgcatactacagattcaccaccatggtgattgtggtgccctcaccgattctggtgtcaatatccatggaatcagagtatttcttcatattcggcagacccatgcctgccccaaatcccagggaacgtatttcatccggcgcagtggaataacctgcctgcatggcaagcttaacatccggtataccggggcccacgtctgccagtatcattttaattttctccggcgttatctccacagtaatgacgccccctttggcatggattaccatgttgatttccccttcatacatagctatggccaccttgcgtatagcatcgggactcacacccatctgtttcagttttcgtttcacatcgctgctggcctcacctgcccttgtgaagtcatctgccgatatgtcatatgttaatacaattgcttcctccataattggttcccttcattaattatatatattttctcccagtctcaaccggaacgcgctgaatcattccggcacacactgaatcagacaccgggagcatcagatagcccctccgtgcagtcctgcctgataaagcataccgcaggcagagaacatgcggtggcccgttgccatgaccacaagcccccggtccctggccatctccaacatggattcatccggtttctttcctctaacaaaaatgatacagacaatgtctaacatctccgctgtccggataacctgcggattgcacagacctgtcagaagtacggagtggtctttggaaaatgccagtacatcgctcatcatatccgaaccgcaggccgactttacctcccgatccaggaattcttctccagccaggaccctggcccctaatacgtcttttacatccctaaccgtcataccctcttctctcctcactatcattacttgtcaattgtacacatttccgtacattatagcataccatccattttgtgtgttttcaatataattccgtttttttacatgttttttatcgttagaattttcacattaatagtagattttttttcctatacgtgataaaatattgatacattgcacaatgtacaactagtgaggaggtaataaaaagatggcttgcaaaaaacaaactgttccctttaaggggacgcctgagcaggaagcagcgctgaaatcagcgattgccgagctgggtgaccagccgggcgcgctgatgccggttatgcagaaggcccaggagatttatggttatcttcctatcgaagtgcagaccatgatatcagacgagatgggtattccgctggaaaaagtctacggagtatccacattttatgcccagttcgcgttacagccaaagggtaagtacaagatatctgtctgtctcggtaccgcatgttacgtaaaaggttccggcgaaatcttcaggaaactggaagaattgctgggcatcaccaatggtgagtgcacagcagatggcaaattctccctggactcctgccgatgcgttggcgcctgcggacttgcgcccgtcatgatgattaacggcgaggtatacggaaggcttactgtcgatgacataccaggcattttagccaagtacaactaagcctatgatgacagagatttccctgaatgtattggatgtatcggagaattccacacgggcaggcgcctcgcttgtgaccatcctggtgaccgctgatacaagcgctgacaagctgaccattgtcatagctgacaacggatgcgggatgacccctgaacaggcagcccatgtaacggatcctttctttaccaccaggaccaccaggaaggtcgggcttgggattccatttttcaaatatgccgcggaaagtaccggcggcagcttccatattgaatcggaaccaggtaagggaaccaccgtgacagcagtctttggactgtcccatattgacaggatgcctttgggcgacatgaacgccaccatacacaacttaatcgtatatcatcctgatacggattttctttatacctatacatacaacgatgcatcatttaccctggataccagggagatgagggagattctgggaggaatcccgctcaacacccccgaagtgtccgcttacataatggaatatctgaaagaaaatcaacaggaaactgacggaggtgccctgatttaaaagggtatcgtcaaacatgacatgtttcgcacgtaagcgcctgaaagacaggcgccaggtgctcataacgagccactccactaagttcgtgaaacacctcaccaagtggagatgacatgtatcgcacgtaagcggccaaaagacggccgccaagtgctcataacgaggaggataatcgcacatgaaaactcttgctgaattacaggcaatcagagaaaagatgcagagccaggtcaatatgcgtgccgaagaccacgatcatatccgtgtggttgtaggtatggctacctgcggtatcgctgccggcgccaggccggttctgaatacgcttgctgacgaagtccagaaaagaggacttaccaataaaatttctgttacccagacaggctgtatcggcttatgccagtatgaacccattgtggaagttacggagcctggcaaggataagattacttatgtgaaaatgaatgccgacaaagccctggaagtggtggaacgccacttggttggcggccatcccgtggagaagtacaccatgggcgctgcaggtcttaaataaaggaggaaagtacgatgtatcgttcacacgtattagtctgcggtggtaccggatgtacttcttccggcagcccgaagattatggaagctttaaaatatgaaattaagcgtcagggactggaagaggaagtggctgttgtagagacaggctgccacggactctgtgccttaggccctatcatgattgtatatcccgatgccaccttctactccatggtgcaggtaaacgacattcctgagattgtttccgagcacctgttaaagggccgtgtggtgacacgtcttctgtaccaggagaccgtaagcccaaccggcggcatcaaagcgctgattgacactgacttttataaaaaacagcaccgtatcgccctgcgcaactgcggtgtcatcaatcctgaaaacattgaggaatacataggtacaggcggataccaggcactgggcaaggtgctcacggagatgactccggacgatgtaatccagacccttctggatgccggactcaggggccgcggcggcgcgggtttcccaaccggtcttaagtggaagctctgtaagcagaacgacgcagaccagaaatatgtgtgctgcaacgccgacgagggcgaccccggcgcattcatggaccgttccgtgctggaaggcgacccccatgcccttttggaggcaatggctattgcgggttacgcaatcggatccaaccagggctatatttacgtccgcgccgagtaccccatcgctgtggagcgtctgaaaatagcaattcagcaggcccgtgaaatggaactcttaggcaaaaacattttcggaaccggctttgactttgacattgacctgcgtctgggtgcaggagctttcgtctgcggcgaggaaaccgctcttatgacctccatcgagggcaagcgcggcgagcccaggccaaggcctccattccctgcacagaagggtctgttcggcaaaccaagtatcttaaataacgtagagacctacgcaaacattcctcagattatcctgaacggtcctgagtggtttgcttccatgggtactgagaagtccaaaggaaccaaggtattcgcactgggcggcaagattaacaacaccggtctggtggaggttcccatgggcaccaccctacgcaccgttatagaagaaatcggcggaggaattccaaacggcaagaaattcaaggcagcacagaccggcggaccttccggcggatgtatccctgccgagcattttgatattcccattgactacgacaacctgatttccattggttccatgatgggttccggcggtctgattgttatggacgaagatgactgtatggtggacatcgccaaattcttcctggaattcaccgtggaggagtcctgcggcaagtgtaccgcatgccgtatcggaaccaagcgcatggtggaaatcctgaccaagattacaaaaggccaggctgtaatggaagacctggataagttagaggagctctgccactatgtaaaggccaactcactgtgcggcctgggccagacagctcccaaccctgtactctccacccttcatttcttccgcgacgagtacgaagcacacatcaaggaaaaacgctgtccggcgggtgtatgtaaggcgcttctctccttcaacatcgaccgtgacaagtgccgcggatgtacgctgtgtgcccgcaactgtcctgccggagcaatcgtgggctctgtcaagaatccgcatgtcattgaccagaacaagtgtatcaagtgcggcgcttgtatggaaaaatgtaaattcggcgctatctacaagaaataatgagggagggaatatacgatggagacaattaatcttaaaatcaacggcattgcagtcgaagctcccaagggttccacaatcctggaggcagcaagactggcacatatcgagattcctactctgtgtttcttaaaggaaatcaatgagatcggtgcctgccgtatctgtatagtagaattaaaaaacggaaagctggtaacttcctgtgtctatcccgctgaggagggcatggaggtatataccaatacacctaaggttctggattccagaaaaaagacattacagctcctgttatccaaccacaaccgttcctgcctgtcctgtgtccgcagcggacactgcgagctccaggagctggcccacgaactgggtgtggacgacgagggatattatgacggcgagattaccccgtctgaaattgatacctctgccgcccacatgatccgcgacaacagcaaatgtatcctctgccgccgctgtgtagctgtctgcgagaacgtacagggcatcggcgtcatcggcgccaacaaccgcgggttctccacctccattggttctgcctttgagatgggtctgggagaaacctcctgcgtatcctgcggacagtgtatcgcagtatgtccaaccggagcactgaccgagaaggattacaccgcagatgtatttgcagccattgcagacccgaagaagcatgtaatcgttcagaccgctcccgctgtacgcgcaggactgggcgaggaattcgggcttcctatcggcacggatgtggaaggcaagatggccgcagccctgcgccgtctgggctttgacaaagtttttgacaccaatttctccgcagaccttaccatcatggaggaggcacacgaattcattgaccgtgtacagaacggaggcgtactgcctctcatcacctcctgctcacccggatgggttaaatactgcgagcactatttcccggacatgacagagaacctgtcgtcctgtaaatctcctcagcagatgtttggcgctattgccaagtcctactatgccgagaaggctggtattgatccaaaggacatcgtaagtgtcagcgtaatgccatgtaccgccaagaagtttgagattggccgtgaggacgaggatgccaacggaatgccggatgtggacatctccatcaccaccagggagctggcccgcatgatcaaaaaggcaggtatcaagttcttagacctgccggatgaggaatttgacgcaccattgggccttggaaccggagcagccgttatcttcggcgctacgggcggcgtaatggaagcagcactgagaactgccgtggaaaccctgaccggcgaagagctgcccaagccggacttcacagaagtccgcggcacaaagggaatcaaggaagcagcctacaatgtggcaggcatggaagtaaagattgcggtagcctccggcctgggcaatgccagagagctgttaaataaggttaaatccggagaagccaactatcacttcatcgaaatcatgggatgccccggcggctgtgtaaacggcggcggacagccccagcagcccggatacgtacgcaacaccacggatatccgcggcctgcgcgcaaaggtgctctatgatatagatacagccaacccaatccgtaagtcccatgagaatcctgctattaaggagctctacgccacttacctgggagagcccggaagcgagaaggctcaccacctgctccacaccacttatgtgaagaggagtattaaccagcactaagcaccataccgtaatccacatgtaataatcacgtatattccgtaaagacagattttcaatggtttttgcaagcaatgtacatatatgcaaaacagcggaccgcaggcttgcccctgcatccgctgttttgctacattccaggaggataccatgacagcacgtcagaaacggatttgggatttactggcagaacacgagtgcctgacatcccaacagattgccgcccttctgcacatcagtgacaggacagttagaagcgatatcaaggaaatcaacggggagcacacctctgaggtcatccgctccaaaaaaggacagggatacttcatagacgccggtcagcctgaaaagaacgtccccgcctcaaaaaccccacgtccggaagacgatctggaatgggccattatccggcaggttctattctgccgtgaaacgccctatctggaactggcggaagaactattcatcagcgatacactgctctctaaaatcgtgtccgagctgaaccggaatataaccaggcgacacagcctgcccgccatcctcaaacaaaacggcatcctctccctggctgcctcagaagaagaaaagcgttcctactacactctctatatcatgaaccggaatgttaaccattattttgacatggaacaattccagcccttttttgacattgttgatttaaaggagctgaaggaacttatgttccgtgaactggacctgcttagccggcatctttatgacactactatcgtccgcctgataattgacactgccgtcatggcggaacgggctgtatgcggctttttcatgcctgaaacgccttctgtcatgcacgaaacaccctatggcaaatcatccgaagaaggcgccttaagcacgggcagacactttttagaagaactgggttcccggctttttatttcctttcccccatcagaatatgagtattttttccggctcttccaaaatgatttttattatgtaagggagcagcccgacagccaggctgaaagcctgctggagaaaatactaatagaaatcaatgtggaatatggctttgacttcaccattgacaagaacttctgccacgaaatgacagaacagctccacggagccctggaacggagacggcacaggcagcacgtcatcaatcctgtcctatccaccatcaagtccaaatatcccttagaatatgatatcgccatcttttttgcagaccgttttaaaaatctctcaggcctatccctgagcgaagacgaaatcagcctgtttgccatccacttcataagggccatggagacaaacctcggaaggacagagcaaagggtggggctgattaatccatatggaaaacagattaaggagctcatggtcaaacgcctgggggatatgggagagtgccgttttcagattgcctatacctggtctgtctttgattatccccatgaaatgcccaaggatatcctggctgtcctcaccacggttcccctgcccgtccagcccgcagatgtaccggtaatcctgtgcaggaactttctgaactatcatgaaaaggaaaaactgctcaccgttgtcagagacagcgaggtcaacagcatacgaacctattttagaacgctgttcaaaccgtccctgttcttcaccgacatggagttcgattcccgccgtagcgccgttgcctttctgtgcggaaaactccgggaacagggctatgtgggacccggtttcctggaaagcgtcttgcagcgcgaatccattgctcccactgcctttgagccgggtttcgcctttgcccatgccatggaaaacaacgcgaaacggaccgcggtctgtgtatgtgtgctgaaaaacaagcttccctggggcgaatacaatgtgaagattatctttctttttgccctggcgccaacctggaaccataccattattcccatctataatgtgatgattgataatctgtttaagaccaataccatctacaaactggcaaagatcagggattgccgtcagtttatggatttgttgatttaacggagcagatataaagcagaaacagcctggcgggcaatgtgtctgacccgccaggctgttattttcattgaagcgtatttatattttaccttatttatttctttcttctcctgcctgcatatagctcacatccccacatgccttcagttcatataggccgtccttataagtcaggaccgtcacactgcaatttgcaatgcgttctccctgatactgctcaggcaccagcaaatctaaaatagttgcaatctcatcgccgctggaaactgccagggcatttccgccgcctgcctcctgggttgcttttacaatggtgtccataacctcaatggaacgctttgagatgtcatcataggtctccgccatatgcagaggatcaatggcagcgattgtatccactttttctttctttgacagctccagataggttgagcccttctcgtcataggaagccccgttggcttcgtatatcggacgccacaattcctcgtccggttttccctcaaagccgccgtaaaactcttcccttaacccgatgacttcctgcaattcagggatatccccttgattctgagccagaatatgctttgctgttgcccgctgccttcctaaatcgccggaaaacgcggtggtaaatacaatatccttcatgccctttccggccgcgtcagcctggtattccccttcctccgtaagaggtgaatccgcccatccctgtacctgtcctgtggtgttaaaaaaagtctttccatgccgtaccaaataaattgtgacatccttcttctccggcgctcctgacgtttctgctgcttgttctactgcctcttgtatcgccgtttccgtattagcctgcttttggcagccagccaaagccaccacccccaaaatcatagcaccccctaagcatagcttccttatcttcatattcatacccctcccctattttaagctctgcttttatacatctccaccatttcctttgccagagccaatgtgatttcagcccccatcataatatcctcgctgtgaatcatgataagtcctattttatccaactccccgctggcatccatcgtaatcagcctggtatgtacatggtgggcctctttcatcttctccccggcagccaccagatgttccccggcctcgtcaaacctgctgtttctggcagcggccagggcagccatggactcgctcctggcctctcccgcattactgataatctgcaggcatatcagttccatatcctccatcacgcttcccccaattctttcttaacctgatttaataccttctctccattcattgtaccgtatgacacaggatcaatgcttgtcaccggacaggccacctgcttctttacagtctccatctggaatcgcacctgggggcctaagagaatcaggtcggcctcagctccaactgcttccgcgtcggaaacaggggcagccgatatctcacatgcaaagtcctgcgcctctgctgctgctttcattttcttcacaaggattccggtggataaaccgccattgcacaataatacgattcgtttcatatttttaaatcctccttcttttgattgatattatatttatagtttaaatgtcctcttccccgctctccagcttaaccagattcttctcataaatcttaaagaacgggaaatacaccagcccgtcaaccacaatcagcaccaggataagcagcggcgctttccagtccatggttgagaaaaatgctccgatgacagaaggcatctgccaggacagcatggcaaagctctttccaatcaggcctacctgcatggtcagatacgcagccgtaccgttgatgaccgaagtcagcaggaagggaacaaaaaataccggattcagcataaggggcagaccaaagataacaggttccgagatattgaaaaatgcaggcacaattcccagccttccaatggtctttaactgttttgattttgaaaaacacagcagtgccgtcaatgccagcacggatccgcatcctccaatcaccacaaaatatacccagaatggcgtggtaaatatggacggaagggcctgcccggctgcatgggcagccgcgtttatggataaattgccgtcgcggataggcgcaagcacacctgaaagggcagcgtcatggataccgaagaaccagaaaatatgtaccatcagtgttatgataatggtaaaaccaacactgtccgctgctgtcagggacggggaaatggcattgtatatcagctttggcagcgtggttcctgccttattcattatggcgtacaatgctatataaattaccatcagcaccgcccccggcacgatggaggcaaatacatcggaaagggaagccggcaccgtatctggcagggaaatttttccaaaatcccgttttctcatgtaacagtataaatccgcggtcagaatggatatgaacatggccgggatcaatcccttgccgtccatataggacagctccgccatttttccgtcccatcccagggacatgggctccacaataagcatcagaaagccgcagacacctaaaagaataggcagaaacgactctatcttccggctcttgcacaggaaatgaatgattccgatgcagatataaagggacatggcccccaaggtcagtgcgttaatccaggagaaaatcatgctgttgctctccacgaacctggcccaggccagggtgattcctgttccggccgcgtccacggagggagcagagctcagtacagctgcaatacctcctgtaaaggtgatgggcagaagggacataaaggcgtcccggattgcccgcaggtgtatctcattccccagcttgttggcaagaggcatcacatatttttccattgaaacgctcatactctgtatattcatataacactcccccattattttcctgtaatatgttttccatccgtttcaattacatccttgtaccagtagtagctttttttcggtctccgctccaggccgttttcataatcaatggcaaccaggccatagcgcttctcagttccatttttccatgaatacaaatcaaacggcgaccaggcatagtacccccgcacatcgcagcctccctctttggcttttaacaccgccgcaatatgcatgtccataaactcaatcctgtcatcatcctccacccgcttcactgatgtgtcctcatagagtccgataccattttccgtgatatagatgggcagatggtatttattccatacctgtcgtatcccctcatacagcccctcgggaaatatctcagtatcccactcagtatagcggctgctctccggccttacctgctcaaaccagcccttaataatggtctgcgaggttccctttgccttctttccctggttattgacaatcagggttgtctccccgctctcataaggtttcaccatgaccctggcatagtagttcagcccaagatagtccaccctgttctggcggatgacagccaagtcctccggagtcatcatggacaggtcgcaggtctttttaagctctcccagcaaatctcccggaatctccccaatggctgccgtatccaatatccagttattatagaaattatcggcaaatctcctggctatggccgattccacgcttgtgtccgtggtatagacaggagaaaagctgtgcacaattccaatctgtccgtcatatccgcctgtcctgaacacctccacagccatggccgaggccagcatcatatagtaggatgcagtgacagtctcctggatgtcctgatgtcccggaggataattgccaatcagataaccgctgttggtataatatcttggttcattaaaggttgcccacagctttacccggtccccaaaccggtcaaagcataccttcgcatagtgggtgtaggccacacacgtatcacggttcagccatccgcccttttcctccaggtattgaggcaggtcccagtgaaaaatagttaccatgggtgtgattccatattccagacaggcgtcgatgagccggttgtaaaaatcaacgccctcctggttcacttccccttccctgtttttgataattctgggccaggccagtgaaaagcggtagctgttctgtcccccttccttcatcatgcggatgtcttccctgaagcggtggtaatggtcgctggccacgtccccgttttccagatggttttcgtgcaaatacacatcccacatggattccactcttccgccttcctgccagcctccctcgcattggtaggaggccgttgctcctccccataaaaaatcgttcacgtttaatccctcctgtcttttatgaactcattatagcaagtcgggataaaaagataaaatttgatttttccgctgcacagaggaaaaaacaagggaaaataacgggtacagaattcaggcagaacaaaatattggcagaacaaaatattggcagaacaaagcctgggcggaaaataaaagaagcggatgcattggccactcctgcatccgcttccggctgaatcactgattcaaccccttatttattctattgtcttctaaaccacggtctctctcctgccgttttctcatcctgtcatgctcccagggcttaaaaacgcggtccagagccaggcatatgacgccaaccatcagaagcaggtaaacccatacactccgtacaccgtgttccgccagtctccacacaatgaagatgcatacaaatgccaggggaaacaggcagcgccttaacgtctcattcttcagccaatagttcatatggttcctgctcattcaaataccgtctgctcttcaatatcagtggacaatgcttccagcgcctttttaacaatgcgcctcctcacctgaagctcttcctcttttggaaggcccggatttcccacaggatacggaattcccactgcgggtatgattctgtttgctcctactgccatggagatgggtacaatggaacagatatgtacaaccggaattccaaaactctctattgtcttagccatcgttgcgccgcaacgagtacaggtccctcagttggatgtgagaattgccgcctggacttcattgcgtatcatatcctgggcaatctcctcagcaaatcgcttggcgctgctaaccgcagtggtgttgccaaccgtactgtagtagcgtccgtagagttccccgatttccccgtcccgctcaatctccctgcatacatccaggggcaggacacggttcggatcctctgttgcatatacaggatcatatcccccatggacagtcatgaaaccttcactggtcagacggtccaggttctctatgtcgtagataccatatatgccggcattggcggacgggatatggtccggatttccctgaggcacaatgccgccggatgtaatcagcgcaattctggcatgagccatatctttcacagcaggagcaggctttacacggtcaaatacaggcatgggaagctcggtgacatacggttccccacgcagcttcttgatcatcatgtccactgcccgctctgctccgttcttttttgtgtgcacattcacacggaatccctgagcaatatatccttcttcctccggaaatccgatttccccgccttcaagcagtttttccgccagcgtacccatgacaggcagcgcctgacgcatacctgcagcagagatggatgtttccacaatatatatcttactgcggaacatttcagcccccggattctccgggtacaatgcagtcagaaccggaatggaaaggcgtttcttaacctcagcgcagatagttgcgcaggccaggccatagcgccccgcattgaaccccggacccgctataaacatatccggctccagtccctctgtcatggtcagtattgtttccagtgcgtcttcctggtgatccgcaaaatagttgtccccgcagataatagtggccacaatctcagccttttcccccagaacagcctgcagccctgtgccgggtcccacaatgccttcccgcaggattggttcctggtcggcaaactcctctccgccaatctgaccataaaactgattcagataatgtacaattctcttcatatggtttctcctctaccgcaaacgtgttgtcatatgctcatagcccatctcacagcatgagcccatgatagccgcaatctcaaccgaaacagttccgtcctcaccgatgctgtccacatttcctcctgtgatgatgcggacagtctctatgtctccaatcacccgttccatctttggcagtaccacaaactgattgccgtttccatttgttaccacagcatctgcctccggggtcacatccgccagtccctgggatgctccgtcacgcccgcagtactcatccgtaaccaaaacggtcttgattcccttattctcatggagtctgcagttgaacatcaaatctgtttcaggattaccgccgccttcctcgctgacaatcacaccatccacgcctaacagttgggacagactgctggtataatacgccgcccgtttcttttctttcagcatggcgctctcattgctcagcagaacgcccacaaagcacagctccttcccatgcctgcgcagcaaatccagtatgatgggattattctcatgatggatggtggcattcttatgtccgggagcagcgcagtttccgcttataatagctccatccagcacctccaggggaccaatcatagtggaaaggattcctttcacattgaggccatatacatacgtatcatgcatcaatccctggcactgtaccatgtccacatatacaaccttgggcagatgcggatacttctgtcccatttccaaaatgctctcatgttcaaatacttccttctcatccggttccagccccagggttgtcttagccatatacgcagccgtcttaagacctgcgatgcggaccgtggcttcgtgggtatgcttgtccaggccttccaccgggtatatcagcggtaccagtatgttcatctttgaaaaactgttaaattcagctcccggcccggacatatcaatgatgccttcctggaatgccacaatttttcctgaggtggcaaccgcgcaatcttccagcacattcgtctccccatttccaaccgtttccacatctcctacaaatccgggaaatacctgtcctgagccgctctgcttgaagcggggctgaaccacatccttgatgggaacgattctcacagactctcccggccttgctatatcaaaatccacactgcggatattggtatcttccatgagatactcagccaattctgctttatttatgtataagacaccgctgcaaaagctgcttgcttctgcaaattggatgtcctgcacatgaaatttattcagtgtcagtttcattatgtttcctccaatatcagtttattttcccatttcctccacttccagcgcccgctcaatgatggataaatcaatgagctgaaagtcttcccgggctgcctttccccattttttgtaaacaggtatatccctcagcctgtacaaatcctcagcatagcggatggccttcccaatcagggtcactgattccatatcaatggtccccgccgtccccgacagcagaaccgtcttatagggtgtgatgtccggccggatgcttcctgtcagcggatgcgtaagaagacggtatccgcaatttaccttctgaaaaaccactctgaacagttccaacacatctgtctcgtaatactccaggtccgtgaaaccgcggtctataagcattggattattggtaatacaacggaatgggtgacccatgtctggttcctccttgcaaacagcattatttggcttctgccttcagatttttcacaagctccacagcgtcttccccatataattcagtcagttcaggccatacagactcccagcatttgttatagaaattctgaagctcatcatctgtaaactcaataatcttgacgccatagtcttccagtttcttctcatactccgcggtttccttgggcgctacctcccacctgtcatcttccagtttattggccgcgttctgcaaagcgtcctgctgctcggttgtcatctcattccatttgtccagattgatatacaggtaccaaacctcaaaatgatcattgtatggcagatagtaggttgccacatcccggtagctgctgtaatatccttctgctccggatccaatcattccgtcaatgaccccggtctgcagggcggtaaagcagtcgttaagggccattggggttgcattgtagcccagcatgtttgtcaccagctccgcgcccttcatggtctggcagcggaccttatatccttcccttacatccagatttgccggctgatttggttccttatttaggattgcgcctccaaagtacaggggataaactgacagcagtttaatgttctggtcttccagatgtgtccgaatggtttccgtaaaatcactgtcacggctgaaaattgcctttgcttcatcccaggtagcgcatatatagggtgcacttgtgattcccaggtatttatccacagtggagctgagggtggccatctgcatctccacatctcccacacttaccagctcctggactgctgtataatctcccagctgcgcagcgggatataccaccacctccagggaatcgtcagccgccttaacgttatctgcaaattccttggcattgatatccgccggcgacccctctgcccggtagtggctgagcttcaatgaaaatgattttttctcagcggccttgcccgcgctttccgtcttgccggaaccgctgcatgctgtcatgcctaataccattgccgcaacaatcgctatagaaagtcctcttttaatatttttcatagtattctccttttttatggtaagaaatcattttcttatacagcaaaaccagccattctcggaatcgcaagggccaaatccggccaataggtgacgagaaacacaatgggtacataacccagtatcaaaaatgtcatggtaggtttcagaatctcatggaattcagcctttcctatcctcattcccagataaaggatgcttgcgtacgggggcgtaactccgcccatggcaagattcacacccataatagaggcaaagtgaatagggctgattcccagctggttcataacaggcataagcaggggcgcgcatatcaaaactcccgtagtgtcatttactatcattcctacaataaacagaaagacgtcaatgatgaacagcagtatatatttattggtggtaatgctcatcagaagttctaaaaccagctcaggaacacgatatacggtaaacacgcggctcagcatcaggcagcatacaatcatgaccataatggagccaaccgtgctggtggcctcttttgtcattgccaggaagcccttaaatgtacaggccttatacacccacaatccaatgggaatggaatagatggctgccatggctgccgcctcggtgggagtaaagacacccccatagattcctcccagtatgatgaggggcataataagggccggtacagccttaaaggtcatttttccggcgtttgacgcaaattccccaaaaggtttcttttccgttactttcaaatcaaactggcggctccagaatacatgtatgatgcaaaataaagccgtaatgataagccccggaccaagagtggataaaaagcaggcaagaatcgagcattccgtcacccatccaaacataatcataactacactgggaggaatcagaagtcccagaacagaggatacagttaccagtgctgtcgcatatcccctggggtagccctgttcttccatcttaggaatcatgatagggccggtagccgccacgcccgtaaatccgcttcctgatatggctcccataatggcgcacacaagaacagccaccacgcccaggccggatttgatgtggcccacaaatgcgtccacacagtccagcaagcgttttgcaatcccgctgcctcccatatacgttcccgccaggatgaatagtggactggccaggagcacggttcccgtggactgggaaaatacccaaatcagcatggtcttcatagatacgtcgccaaagaggctcaaaaacagcaatgcgccggcaaagcagaccggaagggggatgctcagcatcagaagaaaaaccagtaatattacatccataagtatgattgacagagaagtcataggttttcacctccttcccttgcttcatccttgtttttcatttgaccaatcaaagcccggtaggccatatatacatcccttgccgcataaataaacatcagcacaaatcctacggtaagcgctatattggcaaaaaacagaggggcgtatgtaatgtcagccagcttccaggttttcagggaataggaaaagaaatagaatccccagtaacaaatccaggcaagaataatgatacacaatgtacgtttgattgcatcaaaaatcagttttgagcgttccttcttgatataaagggtcaggattccacactcaatatggcttttctcataggaagcattggcgccgcccagcatgtaaagccatataataggaaataacatcaattcctcaatgcccatcagtgatgatttcagtacgtatcgcgcgaatacctcgtagcctatcatgaccaacaacatgagagcagccacaattgacgcgccatactgcacttggatcagtgtttttcccagcttcttcatacatttcctcctcttatagtttttttaaatgatgtaaattcatatcgtttacgatacctatattctatatgatatgtctaatattgtcaactatataacgatatttttttgattaattgttaagttataccgataattgctggattatccccctccctatcgtatttttaacagcaatttacagcaaattaatttttctcttacatttcacaatatatatctatttagatatgtattcacatgtacaaacagcccaaaaacctgatattgcttgaaacgcattcaaatcaatgatataatattcaaaatattacctatgaagggaggttatccccttgtccaatacctcttttaatcaaaaaggagtttctctttactatcaggtagagacttatatccggacaaaaatcgaatcaggtgagtggccttctggatttaagcttcccacagaaacagaattatgccagtattttggggtcagccgcactaccatacgccaggctgtaaataaaatggtagagggcggccttttaatgcgcaaacagggttcgggcacatacgtcacacagcccgcttattccaggaacagactttccacacagcccagtgattctgtgtgcaaatatatttatatgcccattcttcaggacgacatggagcattcctaccagaaccttctgctgacccacatcagccatatactgatgctgtgcgagcaaaagctgatatcccaggaggacggaaaaaatgccctggatttcattgtccccctgatggatatgcatccgcagaccattggctttaatccgcttaacgaggattatttcttaaattttgaacaatatctgatttcccatctgggaatcgatctggccggaaaaatatataccggcagaagccgcaacgatatgactccaactgtaatgcgaatgagcatccgtgacagcatgcttgcggtttacgagcggcttctggcactgatacgccgcttgctggctcttgccgaagaaaatcagggacgtatcatcacagggtatacccactgcatgccggcccagcccataaccctggaccattatttcctggctatagcagaagccctggtgcgggatatggacaggctgctgtctgcttaccagaacctgaaccgttccccccttggagcctgtgccatggccggaacttcctttcccatcaaccgtgaatacaccgcccagcttctgggctttgacggcattataaccaacacgctggacgcggtggccaccagggattatcttttggagcttgccgctgatttttccaccatgggatccaccctgtcgcgctttgcccaggatttgtacctctggtccacagcagaatttaactatgtaagcttttcggatgcttattcctgctgcagcagcatcatgccccagaaaaaaaatcctctgtcaatcgaacacataaagagcaaatcctcccacctgaccagcacttatctggatattgcaatgtgcctgaagggaaccagctatggtcattgcagggacctttttgaatgtatgcccccattctgggatgcggtggaacaagtcaccggaatgctggaattgtccatcggaacactgcaggacatcaccttccactacgaccggatggaatttacagccagcatgaatgactccattttgacggatatggcagattttctggtgcaaaaggaccgcataccgttccgcagcgcccacaatatcatcgcctcagccgtccgggcccagggtgataatcccagcagtaaaatcaccttaaagcagctcaacaaaagcagcaaacagcatctgggccatgacaccacgctgacagaatcagaatgggcatccttacagtcaccgcgcagctccgtggcaaacaaacggagcgaaggttcccccgcccaaagctcctgccggaaaatgctgctgtccctgcgcatggctgccgaccgctgcaatgaacagtacaataaaatcatcaactccctgcagctggccgagcaattcaggaaggaacagatcgatgtgctgaaaaatgggacgcattttgagcataattaatttctatcagtttttatgagtcctatatatgcgaacagcggactccgggattatatcccgagtccgctgttttgttctgcgctctgttttactctgcgctctgatacatagtgcgccctgtcatatgtcagaaaacttcctgcctcaaacacctccactaaatatcccatccgatgtcccttgcccgcagcccatccgactcccagccttttaaacatcttgtctctgcattccttgtcctttaacactttttccgcgtcatcataccgcttttcattcataagaagaagcgtaaacctgctaagcctttccaccccttattccacgccccgctccattccttttttctctccatcctcaaaaagcatctgtcccagtattgtcattcctatcttctcctttacatccattagctggttccgatccagaaatttaactgccaatgcgtactgcacggactgcattctcttgacgtcctcttccttcatatccaatcccggactctccagtatatccatgccgcggcagatgcgttcgctgatttctattgatgtacacagcactaatgttgcagccgtcaccttgtaaatcatgcctatatatgcctcgtactcacgaaaacgccgcaaatcacgttccgttatgctgtcactctcaaatttcagatgtatccatgatccacccattcagcctcctgttccggcaaaccatacaggaacctaccttcactatacttaatatcaccctgccggacaagggcgccctgcctgatatcacacaatttatagttacttattttacttgattcgttggattttacacccggtacagcgggcagatttttacatagatactacgtaatttgattttgacagaattctgttatcagaacttagatttttattcttatacaattatggcggcggtccctcatatgcgttggcgcgttggcgccccggcatctggtttttttatatagcatgtggggatgcctattgcaagctcaaaatagaaatttatccatacccccagccgcaaaaaacttccttttcaaacagcagcggccgggaaatgaatcacatggtttcccggccgcaggctgctccttacttaaactccaacctcaaagtccaatccttccctccggccattcatccgctaaaccagctggttatattttccccgcttcacatagtgggtatgcagcagatgatgggacaaatgtccattgggttcacccagatattcgctgtagagcttcatcagatcagggttctcatgggatttgcgcagcaccttgcgctcatcctcactgtagagagcgtttgaacgtttttcacggtaattctcttccgtgcatcttggctgtccgccgccgtttatgcagcctcccggacatcccattacctctatgaaatgatagggcgatgtgcctgccgccacctcatccataagcatagaggcgccttccagtccgctggttaccgccacattcacggttactccctttaaatgttcgtatgcaggaagcgtatcctcaattgtgatggaggctgtctttacctgttccagtcccactataggcgccacatgcagcttgtcaaagggaagttcctttccggtcaccacttcgtataccgtacgcagagctgcttccataacgcctccggttacgccaaatatatcagctgctcctgttcccagtcccagaggcgcgtcaaactcaccctccggaagattcacaaaatcaatgcctgctgtctttatcatacgggccagctccctggtggtcagtacggcgtccacatcgcggttgccgtccacttccatttccgggcgctgtatttcgtacttcttggctgtacagggcatgacagataccacaaacatgttttccggcgcggttgcggtgcgctctgcatagaaggattttaccacggcgcccagcatggtatgaggactcttgcaggtggacaaatggtctaactcctccgggaactgatgctcgatatgcttgatccaaccaggagaacagctggtaatcataggaagtaccgccttttccttttgggactcatcccccttcagagctgcgttcagtcggcctaaaagttcagttccctcctccaatatggtaaggtcggcggaaaacagggtgtcaaacacatcgtcaaacccgatttcgtgaagagccgttgccattttcccggtgacaggggttcccaccggcaggccgaactcttcacccagggcagccctcactgccggggccacctggaccaccactctcttttcagggtcagccagcgcccgccacaccggtgcaaggccgtctgtctccttcaaggctccggtgggacagaccacagtacactggccgcacatggcgcaggctgtggagttaagaggcagccccatggccgggcttaccaccgtatcaaatccgcggttctgggcctggatcgctcccaccttctgaatctgggtacacacagtgacacatctccggcagagaacgcatttgctggtatcccttgtgatggacggggaaatatccaccatgggcttggtcatggctccctcaaaccggctctcaccgactcccagctcatagcccagctcctgaagctcacagttggtattcctgctgcagttgagacaatccttgggatggttggacagcagcagctcatacagtacctttctggcagccagcaccttgggagaatgggttcttatgaccattccctcccttaccttagccatgcaggaggcctgaaggttcttcattccctccacttccacaacacagatacggcaggagccgtactgatggacattcttcatatggcacagactgggaatcctgattcccactgtctcagccgcttccataatggtggagccctctgaaacctccaccggttttccatttatcgttacatgtatcataatctacctcctatctcctgtcgcagtgcaggcacctgagagcctcgcccatggcatccagcttgtggaatccgcagttcacttccctgaaattgtccttgcgctcctccacagacagacacctggtcgggaaacgcttatggggttcattgacttcaatatccgctatctcaggtatatcaaaccactcgcccatattcagctcgcccttgcctccaaggtactgatcaatcttcatggcagctttcttgccgtctgcaatggcgtgaatcacaacattggcgccccatgggcttacatcgcctcctgcaaacacgcccgactctcctgtctcagatgtaaacctgccgatatccagcttaccgttcttagccacctccacatgagtggtgcggtaaacctgatgatccacatcctggttgatggctgtaacgatgccgtcgcactccaggaaaaagtcagaatccggaatatgagccgtgcgcctgcgcccgtcgcttccataatcagtctctatcctgcggaccaggtgaatgcctgtcacttttccatcggctcccaggaattccaccggtgacgccatggcgatcagcttcacgccttcttccctggcctcgatgatttcatcctttccagcaggcatctccttctcagacctgcggtaaatcacagttacttctgaggttcccagacgcaccgcggtcctggccacatccatggccgtgctgccgccgccgattaccaccagcttgttgggcacggacatatccctcttaaggccgatgcgctttaagaatccaagcccgctttccacacccttaaggtcctcgcccggtacatcaagcagcctggatacctgggttccggaagcaatatacactgcgtccgactgtttcttcatatcctcaaaggtaatgtcagatcctatcctggtattcaggtgaatctgcacaccgctcctctcaattgcatgaatctccttctgcagcacggcctttggcagacggtactccggaatgccccagtacagaacgccgcccgccacggactctgcctcgtacacatgaacctcatggcccatattcgccagatagtaagcgcatgtaaggcctgaaggacctgctccgataacggatatgcgttttccggtagccggtctgggttcaaccagaggcacattgtactcatcccgcagcgcataatctccgatgaaacgcttcacactgcagatagccagaggctcatccacctgggcgcgccggcaatggtcctcacacggatgggtacagacacgtccgcacacagccgggaacgggttatcctgacgaatcaggcggtacgcgtcctcggttctgccggctgccagcagggacatatatccgggtatgaatacattggcaggacatgcattgcggcagggcgaggtctgaagctcggcgcagacgcctgcgctgcaatgcttttcatagatgtgggcctcatattcgctgcggaaatatttaagggtggacagaaccggattgggcgccgtctgccccaggccgcacatggctgtctgctgaatggttccggccagctcctccagaagctccaggtcctcaggccgcccctttccctcggtgatgcgctccagtatttccagcatccttctggtgccgttgcggcagggaaggcattttccgcaggattcatcgcagataaagtccatgaaataccgcgctgtatccaccatacaggtgtcctcattcatgacaataagtccgccggaacccatgattgcccccagactggacagggattcataatccacaggcgtgttcagatgtgtcttggtcagacatccgccggagggaccgccggactgaatggccttgaattttttgcccccaatgattccgccgccaatcttgtatatgatatctcccagaatcgtacccatgggaacctcgataatacctgcattgacaatatctcccgccagggcaaatacctttgtgcccgcgctcttttccgtgccgaatcccctgtaccactgtgagccgttcagaataatgggcgctgcatttgccagggtttccacattgttaatgatggtgggactttcaaacaagcccttttcaaaggggaacggcggcttctgccttggctctccccgttttccctcgatggacgccagaagggaggtttcctcgccgcagacaaaggcgcctgcgccgatgcggatttccaggtcaaaggaaaaaccgcttcccatcacgttctctcccaggatacccgctttcctggcctggtcaatggcattgcccagccgctccaccgcgatgggatactctgccctcacatacacataacccttggaagctcctatggcatatccgcctaacatcatgccctcgataatgctgtgcgggtcgccctccaggatgcttctgtccataaatgcgccgggatccccctcatccgcattacagaccataaatttgcgtccgtcctcagacacagccttcatacccgcttcccacttcactccggtagggaatccggcgccgccgcgccctctgaggccagaagtcttcatctcttccaccacccgggccggcgtcatctccgacagcgcccttgccagggcgccgtatccgtccctggatatgtatgcctccagggaagcatactccatgtgtccgcagtttctcagcgccacacgcacctggcccttgaagaagggaatatcctccatcctcggcacatggaccccctcgtcctcatcaaaatatgtatattcctcgcacacctcatccttcagaagatgcctggctaccacgtcctctgctttttcaggattcatctttgtgtagaagattccctccggctcaaccaagatgacgggacccatggcgcatgtacccatacatccggtgaccatgaccttaacctcatcatccagcttatatgtactcactgactttataagcgcatcccttacttccccgcagttagaggatatgcaccctgctccgccgcacaccagcacctgacgccggtaggacttttgccgtctcagatattcttcttttatgcttaataaatcatcacggttttttactgcatccattactcctgcccctcctcttcatagtagcgttccagaatctgttccagtttgtcaggatttacctgtttgtaaacctggtcgtcaattgacatggccggagccagaccgcaggccccgatacatctggccacctcaaaggtaaacctcctgtcagccgtggtctcacctatttccacatccagcagttcctttaaccgctctacgattttcttgccgccccttacatagcaggccgtccccagacagacacgtatggtgtgttctcctctgggctgggtagagaaaaatgaataaaacgtcactacccccgatacctctgccagactgatgtccagagcgtccgctatgaccttctggacctccagaggcagataaccatatattccctgcgccatatgaaggacctgtatcagacttccctctttccccctgtactctgccgccaactcgccaatccgctttaacagcgcttcttcactgtggtcacagcagcatgcatgtgtgttttcacccatcacttcattcctccttgttatgagcacttaccgcctgttatacggcgcttgtgtgcaatacatgccactggcacgaaaacggccgtcccttgaccgttttgcgcagtggctcacctctaaaagcgttgcgctgctggccgggcagacagctgcagtctgtctgtcggctccctcaccgcaggtttcccccattgcgtccggaggattgtattgtgaaaaattatacaaagttaaggcgggagcaaccttaccggttactcccgccaaaaagaccctgtataacttttactgactttttaaaattatctcgtctgcggtatcgtaaatgaccgcgtccgcttttaattttcataccgcatcctcctgtcttgaattcaggtaaaaattaatgtgcctaaaaatttttgtatattctaactttttttgtattttttccataatatcacaaggccattgtacttgtcaatatacaatctaatttttaacaatctccaaagcagcccaacacttactaattccgtctttatatatcagaaaatttattaatattctcctacaaattctgtcgattttcagaacctctattccttaattttccagcatatggtacaatagtacctatcaaatataaaaaaattttacatgcagaaaggagtccttatgttcgatttagactttattctcacctcactgggatttattgtcccggtcattctggtcatcatcatcattacccagggatacgtcaaggcgccgccggaccacgcatacatcatatccggcctgcgcaagcagccaagagtgctcataggacgggcaggcatcaaaatcccgttttttgaacagctggataaactgtaccttggacagattacagtggacatcaagaccgatgaatacatcccaaccaacgatttcatcaatgttatggtggatgcggtagccaaaatacgggtggctgacgacgacgaacggatgaagctggctatgaggaacttcctgaacaaagagccggcaaacattgccgccgacctgcaggactcccttcagggcaacatgcgtgagattatcggtacacttacgctgagggccattaacacggaccgcgattccttctctgaccaggttatgattaaggcctcaaaggacatggagaagctgggtattgacatcctttcctgcaacatccagaacgtgacggatgaacacggactcatccaggatcttggtatggataacacctccaaaatccgcaaggacgcatccattgccaaggcagaggcagaacgtgatattgccattgcccaggcagctgcggacaatgccgccaatgacgcaagggtggctgccgagaccgagatagcccagaagaacaacgagctggccatcaagaaggccgaactgcagaaggcgtccgatacaaaaaaagcagaggctgacgctgcctacgagattcagaaacaggaacagcagaaaaccatccagaccgccacggtcaacgcccagattgccagggctgaacgcgaggccgaactgcgtaaacaggaagtactggtacagcagcaggcactggaagctgagatcaacaaaaaagcagatgcggaccggtatgccattgaacaggctgccgctgccggcctgaccaaacgccagcgcgaggccgaagccaagaagtacgagcaggagcaggaggccctggccaaaaaagcccaggctgacgcggaacagtacgagcgtgaaaaagacgcagaggcgcagaaggccattgctgaggcacagaagtattccatggtccaggaggcagaaggtatccgtgccaagggcgaggctgaggctgccgctatccgtgccaaggcactggctgaggcagaaggtatggagaaaaaagccgaggcttaccagaagtataataaggcggccatggctgagatgatgattcaggtgcttcctgacatcgccggaaaaattgcagagcctctgtcacagattgacaagattacgattatcggaggcggcaatgattcggataacggcgtaggggccattgccggcaacgtgcctgtagtcatggcaaagctctttgaatccatgaaggaaaccacaggcgtggacctggcagaaatcatgaaggcggatacatatgacgccaaggtcaaccggaacgtgaacctgaccggcgcccctgatattatccttggaagcgggcagaaggcccttaatcctaatccggattcggataatatccagccataaattctttgtgccccatggaggatattttaaattagtatagcagaaacacctcatagaacaacctgtgatatggatacaggggatttctatgaggtgtttctttttacttctattcttctttgtccttcttaccttcccgggcctccttagcgccccaaaccacgccttccatgtcaaatgtgcctgcggatatgtcaatttcatggtctgcttccgctcccgcagacgctctcacattccctttctgcacatctgctgccgtctttcccggcgcacctgctgctcccggcatttccggcatttccggcatttccggtatttccggtatttccggcatattcggcatattcggcatacatgacatatccggttctcccgctgctcccggcacagccgcagtttcccgttcttcccgtacaggctccctctcaggatccctcccaggctcctgtccggctccgcctgtttcctctatcttccagcggatggatacgcggaacaaatcatcctccacttccagcttcatggtaccgccctggacctccacaaagcttctggcaatggcaagccccagtcctgaaccctctgtgttgcgtgatgtatccccgcggacaaaccgttctgtcagctcctcaggagatacctccagttccctggctgaaatgttgcgcatggttatcagtacatggccgtcatcttccctgaccacctggatataggcccgcgtgcccggcattccgtactttgttatattcaccagcaggttttcaaatacacggtaggttttctggctgtccagataaagaaggattttctcctcaggcagattgtaacggaactcaatgccgcttgccgcaatcttatctgacagttcaaaccgtacctgctttaaaaggctcacgatatccacgtcctcctggtgaaggctgaccgtaccgctgctggccttgctgacctcaaacaggtcctctataagcaccttcagacgcatggatttctggtccagcacccggacataggactttctctcctccgctgtcacattctcctgctttaacagatttacgtaagtgatgatagccgtaagaggtgtctttaagtcatgggatacattggtaatcaattccgacttggtcctctcgcttttcacctcctgggccactgctttcttaaagccctcctgaatccggctcagctgttccttaaacgggttgaagattcccagatcctcctgaatctccacatccaggtttccctctgctatctcattgatactctttaacagcgtattatatttttgctgcatctgcccccaatatttctgcaataggaaaaacagaaccagggagtaaattaccagtgccccgattccccagaaccagagacaggagataatggtcagtatgacaaaattagcaataatggccttgcctataatcttggtggaacggcgctcccagtccgtctcgttaaagacattgagggcatttaatgtccagcgcttgatgaagcgcaggaaacgtcccagccatgtgcgctccttgaaatagcgccagggtcccagggaaaagatagccctgtaacaggtaattccccagtaaaacattccgtagctcaccatccagaacgccagattaatgaccactgccatcacatccgcggaccagggaagaaattccgctctcataagttcgctctttaagctgccgtccatggtagaagcaatcagagccatgggtatggttccctcaccaataatacccagccaggccactccgatacagctcaggggttcaaatgaaagcctgcacagcgcgctctttccaatctcaaaccgtttcacagccggcaaagccagggccagcacggtcaaaagccccagtacagatgcacctatggcaaaatagccgttgctgaaacggtaatcccggatggtaagctgctgatccgcgctgttatacctggcatccgtatagccgaacatctgggacggactgcaccgaaacaccacggtcatgtccttgggtccctggaattccacgccgctgtagcggtagttctcgtccagtcttacctccaggggatcgtagaattcaaacctggtcaatgactccttgatgcgcgtaatatcgtcatccctgtttccctttatgtccagaaccttcagtatgccgtttgaattaaagtttatggtgaactgaatctggtcatccttcaggggttcctggaaaaatgtctttggatccgtcacattgctgcgtccataggttccatcctgctcacagaccccataggacaggctggaataatactgcctgtagaggctttcccattcgcttcccgcgctgtcaatggtctgctgcatggactggtaataataaatgtcatagggatccccactgtcgtagaccatgatctgttccccatcttctccatcctctgtctgtaccgcagcttcgtcttccggctgctgctggcggatcttttcctccagccccggcaggaatgtctgggcataggtcagacgccgtcctgtatcctcctgcattttctgatgccagatttcataactgaaattcataacctgggttgccaggtttccaaaattactgctctcctcgacctggcggacggacctcctgttgtggtagctctccgcctttgttttcatatagggatataaccctatggttccggctgatgccaaaagcaatgccagaatgataatcaatattcccagcctatggctgtttttcaattttgtatccaactccccacaccacctttacatatttgggctccctgggattcacttcaatcttttccctcaggttacgtatgtgtaccatgaccgtatccgtattcactgccctttcgttccacacccgttcgtagatttcctctgcgggaaatacacgccccgggttctgtatcaataaaagaaggattttgaactcgataggagttaccttgaccgatttgtcatccacggtcacctctaccgtctcctcgttgacctccaggcctcccagcctgtggacctttggattctctgtctgctttgaattcagacggtccagaaaccggtggtaacgccgcagctgtgaattgaccctggccataagctccattggggtaaagggctttgtgatgtaatcgtccgctcccatattcaggcccagtatcttatccacttcctctgacttggctgacaggaatataacaggaaagtcatatttttcacggagttttgcagtcatggtaataccgtccatacgcggcatcatcacatccacaatggccagatcaatctctctttcctccagcaccctgaggccttccactccgtctgctgcctggaatactgcgtatccctggctttttaagaatatttccacgccttcccgtatctctttgtcatcctctaccagtaaaatccggtccccattcatgttcatttcctccttacgctctttatactaacaactaaaacaaaatttaaccttcataaaaaacaaaagaatatctaaagtcttattgtaacattcctaaacacattgttcaacgggtgataaactgtctaatccagctgtccagccgcaggaagcggtataccatgcattggcataaaactgccgttcctacagacattttctcccaaaaaattgtgtgatattgttatttatttatttaaattgacaaagcaatttacccatgatatggttgtaataaatttttatttagaattatccgtatttgacaaattattctcaattaaaagggaggaactacattgagtacatatgtgattacaggcggcaccacgggcataggagccgccacccgcaaactgctcctgtcccagggccatgaagtgtttaacattgattttaaaggaggcgactacctggccgatctgtccgcccctcagggacgtcagggagccattgacgaggtgttccgccgctatcccgacggcattgatgtattgatatgcaacgccggcgtgggtcccacggcgccgccccagatgatatttgcgctgaatttctttgccagcgtcaagattgccgaggcactgcgtcccctgttaaagaaaaagaagggcaactgtgtggtgacctcctccaactccataaccaacatgacagtgcgcatggactgggtggatatgctgtccaacgttatggatgaagaacgcgttctggaatttgtaaaggacattccccgtacccaggccgcatcctgttacagctcctccaagcatgccctggcgcggtgggtccgccgggtttcaccgtcatgggcagtggacggactgcgtattaattccgtggctcccggcaacaccactacgcccatgacccagaacatgaccgatgcccagatggaatccgcgctgctgattcctattcccacccgctatggacgcaaggaattccttgacgcggaagagattgccaacggcatcacctttctggcatcacccatggccagcggcatcaacggggtcatactgttcgtggacggcggcatcgacgcgctgctccggtccgaacgtttctaaatgaaaatggaggatatggatatgacaattctggaaagctatattgactgtatgcaaagaggcgacgaagcggccctggcggatttgttcaacgaatacggagtgcttcatgactcgtctctcattaaggcaggtatggacaccctccacctggaaggcagaatggcagtggaaatgatgttccaccacaaattcggctttaacggaggtccctttcccatacacagcgtaaaatatttggacggcaatacggtatggtatttcatcacctacaacgaacatgtggttcctgtaaccgcattcctttccaaggtggatgaagacggcaaaattctgcggctgaatatctatccgctgtaaataaaaggaccggagctggaaggaattgtttatttcccggctccggtttgggttttattcaaaaatgaccagtttttccagtgtcttttccacatctatcagggaataaaggctgtcattccacatgaaatatgctttttcagcccataaacctgtttcctgctgttccggccccctgatttgttcatccctgctcatctgggtcagataaggttcctgatacaaaaggatacccagataatatctctgatggcggaggaccagtaccatctgcctggcgtccgcctcttccctgccgggctcagggccttcctggcagaccaccggcacgatgctccccttatagttgcacacacccgcaaaatgttccggaaggcacggcatcagggaaatcattacatccttgcagatttcctccacatagggaaactcaaccgcgtaattcctgcgctttcccggaatgcagagcacttcctttaacgcctcatccaccataccttccctccttctcatatctgcttatgatgatttccgtatccagcgccgcgcagatacggccgctgcccatgatgctgcagccgcagatacctgtcctggaacggaatcccgctcccaaaagcgcaggaagattcttcaccacaatgcgcttctgttcatagatggaatctatgagaaagcagccctccttctccgcacccttcacatataccagaatggcccgctccggaatctccccttccagggaatagaacctgcggagattaataagaggcaccagccggtcttcatacaggatataatcccgtccgttaatttcacgaatctgtcccccaaaggactcatactccagaaaatgatatacatgccgggccggtatggaaaaacggtattgccccacacggaaacgcacacactcaatggaagccagattcaggggaacggatatggaaaaggcgcttccctgtccaatggtactgtggatggaaagatttcctcccacgtcctccatgatgttttttaccacatccagacccacgcccctgccggaatattcggtaactgtttcattggtggaaaagccgggagaaaggataaactccctgattttccgggaatcgtactcatcgtccgagccggcaaacagccccttttgcctggcccgctccctgacacgttcctcgtcgattccttttccgtcgtcgctgatggtcattctaagctccccggccacattatcagccgaaaagattatctttcccctcctgtccttaccggcagccagccgttcctccggggattcgattccatggtccacagcattgcgcagaatatgcagcaatgcctctgatacatagtccaccacactcttatccgcttccacgtccgaacatctgaccaccagatcagcctcttttttctggtcacggcaaatatctcgcagcgccctcttaagctttggcacaattctggacacaggcacaagacgcatctccatcacggaccgctcaatctgtcccgccaaaaggctaatctgatggcccagtccgctctctaaatcctccatcccactccgtttaagttcattttccagcacctgcatctgaagcagaagctctgaagccaggttttgcagatggtccagacgctctgtccgcacctccatgaattcgccttccctggaatctgtattctcccgctcaggcgccgctttccggagagctccatcctgaggccggctgtcggccaataccctgcactgtgccacaaaaagacccttcctcagggtctccagcaccttctccttatcgctgctctcaaaacggatgaacacgccatggccttcgatgtactgcgcgctttcaccctgtttctccaggttttccggataagtctccaccagggtgcagaggccggtaatggagcgcaccagcatgaaagcacggatattttccatgcggcatccttcctccagagtcacgttgactacggttccgcttttggagacaaatagttcaggaatgacaggcagttcctctctgccatcttcctcccccggcttattcccgtccttcccgctgtccgtctcttcttccctgctgacatgccccagaaagtcatccgtcatctgttcaagcacagacgtatccccgggctcataatcctccctgtccatctgctctagctcctgggtaataaaatcagaggcagcaaacaaaaggtcaaatagttccggttttggatgctccagcttgtccatattttccctgtagtaagaaaacaaatcttccagcttatgggccagggaagacaggccgttaatgcccatcatggcggaggaactcttgatggtatgcatgaccctgaaaatactgtgaatactgctttcgctaaatctgccctctctctcagcctctaaaagtatctctgccagctggccgtttaactgcctggtctccaacaggtatacttccagcatctccagggcatctgactcaaaatatcccataatacgctccgtccattactgctccccgtaccacacgctctggttcttgccatgccgtttgccataatatagcgccttgtccgcacagccaatcccttcctccagcccttcctgctcatggaagatgtgaagtcccagcgtcatggtacaggaaaagcccttatcgccgtaaggtatcacaaattgctccacctgccggcgcaccttttcactgagttcatatgcctcgtcctttgtcacattaaaaagaatcagaagaaactcttcaccgccccaccggaccactctgtgtctgcggcagtttgattccaggatattggcaatgcatacaagcgccatgtcccctgcgtcatggccgtatgtatcgttcaccagcttgaagtcgtcgatatccgccatgataaatacggtttttacctcatcctgaccgcaggaacgcatatcctccattaaatctcccaccacataccggcggttatacagacccgtaagcccgtccctgtaggccatgtagttaagcttctccatattattgcgaagctccctgttctggcggtccaggtcgtccctctgctttttctgtatcaggtgcgcacggattctggactggagctcttttttcacaaagggtttcttgatataatcacatgcccccatagaaaagccttttaccacatcctcatcgctggacctggatgtcagaaaaataatgacggcatttttatggtctatgtcctgtaatgtttgatacagctcatatccatcggcatccggcaggaccacatccaaaaggatcaaatccggctggcactgtctcagctgttcctgagcctccgtgccgctgtgagcctcgcagattatgatactctcctccttcagcgctgccttgatttgttcacaaatcaaaagactgtcatccacaattagtattgtctgtttttcatccatggacattatttcccctcccggctttacaatacgatggctgaatgcctgaccgtattcacttccagccttccgttttctgcataaaatagtatggtcctgccgtaattccggcccgtatgctgggctaccagccgaattccctcctgagcaaggctttctcttacggcttctacattctgctgccctatatccatctttccggacgacgggccaaacattctggcgcccccggcaatctttgcaatcagatctgcgggccgtgctccctgctctctcatctgattcatcagcccatgtatgccctcatcggcaaacttgtaggcgttatcccaatgggctgaatacttccttcccggaagtataatatgggccatgcccgctatgcgctccctggggtcgtagagacaaacccccacacaggagccaagggcataggatataagcacctgattttccctggcaacctttccttccgcgattcccacaatgattttatccatagcgctgctccctgagccgtgaaagcatagttcccaaatcttcctgctccggaaggaaaagaatacgtcccttaaagatttccccggacatatggaatatattttctatgagaagtatgtcatcgcttacaattacccacctggacatgggataggtgagaattgccccgcccatatcaatgcacagctccggcaccgacacatccatatccatgtccatcagctgggacagggcccgtatgtaggaaccgcacatgatgttccccagctcactgatcagagaacactccatatcatccagagacgtaaggttccgttcctcctcccccaaaatggtatttattacggtcttggtaaaggcttcgctcagcataaacaggaaaatcccttttagctggcccgtaacttcaatcagaatgccggtctgcaattcctccggctgttccagaagctcatgcatcttatagtactttaccactttaagggaaggcaaatccaattcaatgggctgttccatcatccgcgacagtgaagtcactgcgtttcccgtccctacatttcctatttcttttaatatatccatggatatctcatccagctgtacataaccatccattccctgtatctcccgtgattataattcaaacttctccaccagctccttcagtagctgggcctgggcagacaattcctcgctggccgccgcgctctcctcggatgtagctgaatttccctgtacaatctcggaaatcagttccacgctctttcttatctgtgtaatggcatccgcctgctgtacggatgtctctgaaatcttatccatcttatggcttacctgtctggcgccttccacggaagccttcagggtctgggctgttacattcactgctttcatgccgtcgcttaccgcatcggaattcttttcaatcaattcagctgtcagcttggacgcgcctgtggtcttggttgccagccgcctaacctcctccgccacaacagaaaatcccctgcctgcctctcctgccctggccgcctcaacagcagcattgagcgccagtatattggtctggaaggcaatatcctcaatctgtctgactatgcctgtaatctgtcctgaattgtttttaacctcatgtatggacttcatcagggtttccatctgcccgtcgcactcctccagcttctgacccaccagggctgcctgtcggctggaatccacggcgctgtcggcgttatcctttacactctgcgcaatctcgttgatgctgaccgccagctcctctatggagcccgcctgctcagaggctccctgggccagtgcctgtgaactgtttgatacctgctccgctcccagtgacacctgctccgcgctgctgttaatctgctgaagtgaattgcgcagcagacggctgatttccttaagcccattgcccaccgccacgaaatcacccctaaattccacatcagagctgtaattcagcctgccgtttccaagggcagtcagaccgctttgtatctcagtcacataactgtacagaacctgtgccgtatggcggatgtcatctgccagctgacccagctcatctctggacctgtaactgagggcaatattcaaatgcccgttggatatggtgtttgccgcctccttcacctcattgatggggcgcacaatatttctggtgaccataacgcatataagaatggtggctcctatacatgccgccgacagtataaccagcaagattatgacccggtggttgctgtggtgttctgtttctatgctggccgctgtttcctcagccgaccgatccgccacctccgagagcactgtccttacatcattggaacggggcaggtactcatctgcatatagggacagcaccttctcattctcgcccgcttccagaagtgtcattatcctggcccttgtatctgccagtgtctggaatttttcattcagctccttcatcttttccggcgctgtgatataccccgtggacagttcggacaacgcggcttcctcatcccggatcagctctctggtattctgcaggtacgcatcctcgtccaccagtccttccgtggccgccaaaatagcgatatttctccccacagcacgcaggctggcagtcatcctcagggatgactgcacattggcaaactggtcggcgtaaatggcttccatccgcgacgatatggtctccacgttgacaatggccactgtcaccgtcaccacatacagaaggataatggataaaaacgcaatgaccattttctttcctgtcttatagttcctaaaccgttctctcatcctttgtttccccgcttttttactgttccagacagcgattgactatcctggaaaactcatccgccttaaatggttttacgataaagtcagaggcccctatggtcagggctttctgtatcatcatctcctgcccgaccgcagagcacataatgaccctgacattgggaaccagccccagcatctcctccagcacctccagaccggaacgtcccggcatggtgatatccagaagtaccaggtccgggctgacctcccgaaacagctccatggccttttccccgtcctgtgcctcccacacctgagtgtatccggcttccttaagtatcttgcggataatgctcctcatgaacatggcatcgtctactaccagaatcttcttatccatatagtccccctttatcctcattctctttgacaggctttttatatacagccggaaaaaccgtttccagcctggtttcttccctggacaaaagctctgcatggcccaccagcagataaccgcccggactcaggcagcgttccagctgctttataagcttctccctggatatccggtcaaaataaatcatcacattcctgcataatatcagatcgaatttctcaggtcccggaggcatctccatcagattatgcctcctgaaacggatattgtattttaatttctcatccacctggaatgtatggctgtcccccgccgtacagtactttctcttccaaaggtccggaaggtcctccatttccttcagcggatatacccccttttctgcctttctcaatacttcagcagatatgtctgtggcaagaatgcgaacagccggcatacgctcaaacctatccctgtaatcctgaatcagcatggctatggagtagacctcctccccggtggaacatcccgcattccaaatgctgcaaacacccatcttccggttttcaaacagttccggcagtatcttgtaatgcaggatagaaaaatgggccggctccctcataaaataggtatagttggtagtcaggcggttcaccatctcgccagccatctcaccggtccggtcctttctcatctgctccatatactgggcaaaggatgtcaatcctctcttttccagctccctggccatcctgcactcgatcagcacctgctttttttccaggtttatgccgtaattgtcccggatgtattccacaatctcacagaattccctgtcattcaatcgtatcacattttttctcccatattcccggcattgcttccgccatttccccaggttccccgctctcttccgttccgggttccccggtgactcccatcatagtcccatccctgagacccaggatgaatccgcaggcgcagctgccgctgtctcccagccgaaagaacacaaccggaattctctcatacagcatgattccgcagatatgggcaggcgcgccaggcacctgctgtatctgcggatgtatcaccacttgcttgatcaaatttttttccacatacacggtacggcttccgtctcttacggtaaccagctccatcattctgtctccttcacagcaccggctgcggtataagaagttccgggaccactataaacgccagttttcctttttcctcttctgtatccaatacagccatgcgatccatatactggttccggctgcttctcactgcctcaggaatggaatatatccgttcttcctccacctgtacaagacctgtcacttcctctgcccctataccaatctccctgcctccgcagtctgcaataacaagataagtctgacctgacaaatcttcagcctccaaaaattccgaaaaatcagccaaagccatctccgggtcccgctccttcatgtccgtcacccgtttcacacaggaaagcggaagaaggaaatgaaaccccgctgaaaaaaagagcaggtacgaattcacgccgtcagccatccttttcccctccccatgatttgagttattctgatccgaaacattttgtttatattctaccatatatgggagttatttactattggaaaatacaaaaaaggtccgggaacatgtcccggaacctttactggtccgtgtataaaaaaagcttctttattttgtctgaaaaatcaatccccagcctggcagcctcttctttcaggcgttccctgtccaatgtaaaatcaatggtatccttgcatgtaacctttaacgaagatgccaaagccgctaatccacccaggcctacgctggaatcatgctcataaaacggtactccgcatatcaacccgctgataacagtggcgaggaagcaatctcctgctcccgccgtactgttgaccggcttccatatagctggtatccgttcgctgtagccattagcaaagaactgggctccctctcccccctgtgtaacaattaactgaattccaggattttgactgcgcagaaacccataacactccggtgcaccactttcagcttccaccccgcctgccgtcacaagggtttccatctcatgcttattgatagccaaaagatccacatattgaaaagcgcctgaacttatgcattcccccatctcgtcagaagtaaacgatgcaacattaaagcaggaattctctcttccctttttcaacaaatacaggcggatatccagaggaacctccggtgctgccagtacaagccccctgccttttaattgttcctgttcaaaaaaggcagctatatcctcctctctcatattgccgctggcactattgctggttgtaatattacctccgtcactgtcaggatatacaaagcataccgaatacatggtcttttcatgagaatccacatttacatacctgcagtttatcccgtactgctccattagtcccaggacctctctgccgctgacgtcatccccgactctgccgattgcatagacaggtatacttttattcagataggttataacataatgaagaataatgtgaagcttacagaagtcccgcacatccataagttctgccagcctggactcattccttcccaaagtgatgttatctgaaaaacggaagaggattcccgaacctatccctccggttcccaccacgtaatcgtatttcagttttctcatatatttactcctgaaaatttccattcgggatgccttgatataggatggttggctgtctcataagtagcagtaataatggcatcctcatgatcctgaagaagcgtcataggatactccgaatccttctccgaaaatagggccactcttaaagccgtttgtttccaggaacctgtatcgctgtataacctgaccttctttgctgacagacattccctgattccaagtgtaatggacataggagggacaaactgatatgctgccccataagacctttgtcccaaggtgataatggtatccaggttattctcctggatacgaataccggattccttcagttcctctatagtaatatgggaaaagggatgtcttctgctctgattataggctatgtgcccatcctgcccccatcctccaagcgtgtaatccaacggtgcctccgctatcttttcttttacttcatacatattctttggggtcagaaaattcctgttggcttcaggtatatttaaatccggatcaatgggaccataaaattcacgaagcataaatgtcctaaaattatagggatcgtcctgggccaacagatttccctgccagtccagacattcatccatatggaatatagttacatgcttcatgtttatccggtttttgtttatatactcagcaaagggagcataccagcattttggcccgcatggcacaatcgcccgaaactgcctttcttctctgcccgcctgagcgatttcatcaacaagctctctggccatcatttgtcccatttcacaggaatccttcaccattctgaaccgtatgaccaactcaggatgggactccaactcttccgcaggtatactgcaccatttatataaatcttgtttttttatcatggcttagactcccgactcctctgtttctgccttccagcacaaacagggctttgtttacatctcaattagtttaatatccgttaagtaacaaaactctttcagggttccataaatctcttcatctccataggccagagttatatattcactgtcccacacctgtacaccatagtcatagtccacatccatcttaataaatgcgtgaggccagaaccacatgccggattcagtccgctggtcctttaaatcatccggatccggtgtgtaaacctgcccccggtgaagaatcatctcaaacattccgttatcacgtcctatgcgacccattacaacctttccgggttttagaactgcctctacggacaggcctcctgctgaaccttctgtaggtaatccatgatgtgcaaatctggctttgtccggcccggccagggagggcgcacaggcaccatcactaattacctttaccacttttttctccttatcaatgcattggaaatcaccataatatactggatccggagtcagattacttaacaggaatacagtgagtacattattataatcacacagtgtcgccgtgggaattccctgctgcagcatcatactctgcgtaaagcagctggcagcatattcctctgccagaccaggaaatgactgaatgacatacatatcaaatttttctttctcaattactttttttactgctaaatacaatctgattgaacgctccgtgcaaccgtcatccggtggcatctcctgaaaatatggcttaatcagattctcttttacgtcctggatttcttcttctgtcacttcttcggcagctttcaatatatccatggaatccctggaatcaatgtccacaccaaactctctcatgaactgtgacggatccgcacatccgcaggtcaatcccattcctcttcctccaaaggcccctatggttgtcatattcaacttattccgcagtgcgcacgcccttgaaaaacatgccaccttttcgaccgtatcattgtcacttccatacacagaacggtacttcatgccgatttccttaaaagatgcccctaatgctagggttcctaccagtctccatccctgggagcccggcacggtccagataataacacccttgccagcacgttcaaaatctcttaccgctgccacgatttctgaagcccatacccaagttccggaaaaaagaatcactccgtccacactgtcatcatgctttaatctggcaagcgcctcacgggcttcatgcttataggccactacaatttcattttctaccagctctacacctttggcctcaatggcagccttggattcatctataatcttctggttaatgaacggcactcctaaagggtcctttaacccatccttatgtaccccaaacacgataaatcccatctttggccttatcatcataattcagtccctcctgacttcaacattaatgttttctttaacaaacgaatttcctatctaaagtctgcacaaataataatctactcggatttctgctgccgcttctgtatgaatcggtcaaatcccactgccaataacagcactaatccctttaccaccctctgccagtaatcatcaactgccatcattgtcattccattagtaagaacacctattatcaataccccaaaaaccacatggctgatttttccgacaccgccggtaaggctgacgccccccagcacaactgccgtaatgacatccatctcataactctcaccggccctgggctgtccgctgttaagacgccccagcatgactaatcctgccagtgcactgcagaatccgcttaccgcatacacaaacgccttgattctgtgaacactgataccagacaacctggctacctcctcatttccgcctactccatatatgtatctgctgtgcctcgtctttgacaggaagaatatacctgccgcaaatgacagaacaagtatgatgaccggtatggggactgctcccacatagccctgaccaatgacagcataccgtgaatcgaatccaaatacaggagttcctcccgtaatcagatacgccacgccgcgtaaggaagtcatggttcccatagttgctaccataggaggtatccctatgtgactgataacaagcccggttgcaaaccctataagggtacataaggctagggaaatcagggatgcaataattggattaacattgtttatcatcatcattgctgtcaggacgccgcttaccccaatgatagcccctaccgataggtcgataccccctgtcaggatgacaaacgtcatgccaatagcgcagattccattgatagatacctgccttaacacattggcaatattgctgcccgttaaaaaattaggtgcaaatatgctcatagccgcaaaaagcacaataaaaatgattattatggcatattctgcaataaatgtattaatattcattttattcttcatatgaataccccttctataaagctgcataattcagaattaattcctgggaatattcttcaggcatcaattcctttacaacctgcccctccttcatcacgataatcctatccgacattccaatcagctctgacatctccgacgataccattatgatgctggtgccgttgtcagccagttgtcgcatgattttatagatctcctgtttggctccaacatctatccctctggttggttcatcaataaatagcacattgcattccgttgcaaggcatttggcgagaacaaccttctgctggtttcctccagacaaattcattactggctgcagaagtgagcttatttttatggaaaggtcagcaaccagcttattgcagatatccttttcctgcctcttcttaattacggcaaagcgggataatctgtccagaatggcaaatgatatattatgttctatgcacatccccataattacaccctgctgtttcctgtcctccggcaaaagagcaatactgtttttcagggccactgccggcgaggtaatgtttattttttttccctttagaatgatttcaccttccgtaatttcatccgccccgtagagcgccctgagaagttcagtccttcctgcacctactaaacctccgattcccagtatctccccctttctcaaaaccagcgacacatccttaagccttctgttgcttacatggctcacctccagaattttctcctcgttgatgtggcctaaatcgggaaatgtctcccccatctcccttcccaccatatctgcaatcagggtctcacggctggtctcagaaaccggatgagtagatatatatttcccatcccgaaaaactgatactcgatcacatatttcaaagatttcctccattctgtgggaaatataaatgatagtgattcctttcccctttaactgtcttacaattgtatggagagtctctgtctcctgttctgtcagcggtgccgacggctcatccatgataatcaattttgcattctttgagatagcctttacgatttccaccagctgctgctgtgcaatccccagtctctgaacacgaattttaggattaatggccattccaatctctttaaacatttttttggtattttcattcatctgctcataatccaaaaaaccttgtttcatgagttcacggccaaaataaatgttctcacttacagacaggaacggtatcagattaaattcctgataaatggctgttattcctgcgtccagcgccaatgcaggagtcaatccgctatattcctttccgtcaaacatgattttaccttcgctaggtgcgtgggcacctgtaagaatcttaataaaggtgctcttccccgccccattctctcccaccagagcgtgtacttctccccttctgacagaaaaatcaatattattaagggccttgattcccccgaaccgcttggaaatcttatggacttccagaattatatctgtattatcaatttgaggagtttcctctaaccgattgttcattcatccacttcctccatcattcctcgcacttcattatggctagttttcaaccacatctctctgccaaactggctcataccttctctgaaccactgcatcttcctgtttttctgttaaatatttatacatagcttcggccaggtcctcacctgcttcataagggaacaggttgcaggatgatctgtaaacactgttttcaactttcattttttcttttccttcatccgtggcatcacagccgccgatataaaaattgtccggaattttctgcatggccgatactgcttcgtacgcgccaattgccgtaaagtcatcgcaggcacatatcacatttacctcaggctttgccaacaaaacggactccgtcaccttcattcccagatctgtattgctggcattctgtctggctaccacctctgcctcaggcgcgttctccaaaataccatcattgatgccgtctcctcttcggatgaccgcctccacatcatcttgggcaagaatcagcgctcttccttttccaccctgttctgctttaatccactcagctgccgcattgccaatggcatatcctatattatactcatccagagagccgtcaatctgcgcattgcttacaggctgcgcctctgcggatactacgattcccttttccttagcctggtccaccactgttttcagggcattctcatccaaaggtgatatcataattccgtctacatcacgctgtaccgcgtcctctacataggaaacctgagtggctacatcatacttggaatccaagatctgtgtcttaattcccagttctgcacattttgactggaatccatcgtaaacctggataaaatacggattggcactgtcctgcgtcacatatacaaattccataccggagtctgccttatcatccccaccggatgtggcggctgtatccgtattcttctgttcagccttatcgcccgcgtttccacccgaagcagagcatccagccaaagtccccataagtgaaagaactaacaacattgctaccatttttttcttcatgaatatacctccttttggcaggaaaatgattcgaaacgtttcgattttcaggtaaacattaaggtgtttgataaacaccttaattctttatcgtttgacagtgtctctgataatcaaggatggctccaaaataaccgaatcaggaacaataccatactgcaaaaggttcatcaggttattgactgccagcttgcacatacgctcgatgggctggctcacggttgtcagcggaatctggttgattgtagcgtatatgacatcatcataaccgcatacggacaaatcccttggaatagataagcctttaatcctggctgcctgaagcactgcacaagccgtaaaatcactgttagtcatgattgcctctggcctctccttcaatatctccatggccagcttctgcacatcatcaaaatgataggtactctcataaacatttgactcggaataaaccagaccggcttcttctaacgccatcttataaccgctgatatatgtctcatcaacccgtctgtcgccaatcagcatcacgatgttatgaatatcccgttcaatcaaatactgtgtcatcagataggagccctttttcagattacacataacaaagggtgcgctgctctgctcatagtaggcggccagaaacagatagggtattccatattcatccagcttcttcatatgttcaatatcattgacataagtcagctgcggaacccatataactccatcaacctttctcgaaatgaattcagaaatatactttttctcattattactgctgtttcctgtaatccctaatataagaaaaaagccgtaactttccacttctcttcgtatgtattctgtaatctcactataaaagcagtttctcacatccggtataagcagaccaattacctttgttccggatgttctcagattacgggcagcattattgggctggtatgatagctcctctactgcatccaataccatcttcctggtcttgtctgtaaccccctctttcccattaatggccagggatgctgttgatatggaaacacctgctagtctagctacatctttgattgtagctctcttttccattcattttcctcctagttgcataaaaacgtttcgataatacgattatagcacaatttttcaacttgtcaacgaataatactatacattttatacagttatcaatcttgttttatttgtttatctatgttaaaatcaataatcatacattgaataaggagaaatagactgtgataaataccgaaaaatcgaaacgtttagatggacagttttattataatcaggaccctctattactggaagaacacctgaatgtccagatgctgcttcatcaatataatcatttgcctccgaacaaacgtaagaaacgtcggaaactcctaaagcaaatcctaaaccatccaccaaaggatgcctgtattgaacagccgtttcattgtgactttggctacaacatccatattggcagccatttttattctaattataatctgaccatactggactgtaataaagttaccattggacaccactgcctgattggccccaacgtcagcatcattaccgtgaatcacccccaggacagaaagctccgttccagggatttggaatatgccacacctgtgaccattggcaacgatgtgtggattggatgcggtgccatcatcaaccctggcgtttctatcggagataatgtcatcataggttcaggcagtattgtaacaaaagatatcccgtccaattccctggcggtagggaatcccgccagggtcatccgtacactggactaaaaatcagtaaacaccagtactgtcctgctccctgaacctcaccggcgccacctccggcgtcagcggctccatcctgtattccggcaactggtcaatgagaccatccagacaaagagatgtactgtggaccatgtcgtgggccagaaggactacctgctgccttcccagaatggttttcatggcattgtcaatcagctcctggggccgggactttttcagcgcgtcgtccagactggcattccagtcaaaatagacaaatccccgtgcgtccatctcggctatgatttccttgtaaaccttccggttatagccattgatgctgcctccgggaaaccggtaaagaacaggctttaccccggtaacttccagaacagccctgtaagcttcctcaaaatccgccagatagctgtccctgctttcgtagagttccttgtagtcatggcggttgcagtggataccaatggtgtgtccctctgccgcgattctttttgcaacatcggggtgtttcctgacattttctcccaccacgaagaaggtagcttttatattcctggctttcagcacatccagcaccgcactggtattttcagcggaaggaccatcgtcaaaggtgagatacatggttttgggattaaaatacagatcaatgcctttggcaataccctctgccagtttttcctggtactgcgggtctgtcagccgttctctttcacggggattagacaggaaccccgtctcgatcaggcatgatggaacaaaggtttgtccggtaactgtaaattctgcatcccctctcagttcacgggcctctgcccctgtacttctgactgcttccttgtggaccagcgcggctaaacgcctgctgtccgaagccccgtccttttcggaataccaggtctctattccccttgccgccgcgtcctcccatgtattttgatgaatgctgacataagcaccggcccggaccttgtgtgctgcctccaccctttcttcctttggacggtatgtgtcgtcctcccgcaccatcacaacagcatatcccatatcctccagtttcaccttcagccgctccgcaatggccaggttaatgtccttctccattacgccttcctggctggcaccttcatcctcaccgccatggcctgcatccaccgcaatgacagggggacctgtatataaagaattctgactgccaaaagaaaggagggattccccctggccttttatggaactttgcaggacatgtgtgtcttccaatatacgggacaggatttctgtccctccccgtcctgcacattgccactctatcctatcccgctctgttatttcctgctttatccgtccctgctctgttcctgccattcccaactcccgtttctccggtatgaccatggccatcactgccatggtcatgcatatgcccgccgccaattctgcggcggccagaaaaaacgcccttctcctggccctgcgcctggcctgccttctgcgctctgtctgcctgccataatcatacgtttttatccctattctgtccatgacgcctgtccttttcatgtaaaaagctcttgtgtactgcaatcagcatacacaagagcggcatcaaattatcatcatttttgcatcaaagttgcatcatctggaaattttcaggaacaattcattgattccttcataaaaaccaactgttactatggtttcttcctcctccccttggctgataacatatttttcaaagtaaggggttgcttccattaacggattctggtccccgaaggccgccggcttctctaaccccatataggaactccacgtacccacaatctgctccggatccatgtcatcccacagcctggacgacctggcatagaattcataaatccttccgttatctccatctatataggcttccatgagacggttttccttgtccgtatttttctggctgtttataaggctcagtttccagaccgccacattattcctgggctccagcacatcaatggctgaatagaggacagcgtcatactcatccttttccactggccgaacggattcaggcaggattcccagtgttttcagttcctccagcccccggttgcatgtctcataaatctgggagtccgtgatttcctggccggaaggccctctgtgattcatcacaaatgcataagccccctccagactctcatattccgcctggctgccgtttgccgccgtcaacgcctgccctgtttcaggtatcagagcctgtcctgtttcgggaaaggtctggctgctcaggctttctgacaatatgtggagcttttcagcggcgcttaatgtatagcggtatccctccccctccgtatccgctgtcatggcatgtatctcccccaacatggtcctgtccctgtatctggtcagcatctcaggaccgcagatggacagggccataatcagccccgcaaacaacaggaataacaggtttgctgccattcttctcataactggtcctccttccagaggggcagggtgaagctcatggtggttcccttccccagctcgctccttatgttcaggcggcttttgtgaagctccagtatttccgcgcacagagccagtcccagccctgccccgttgcggcttctggacctggacttgtcaaccatgtaaaatgccttggtaatcttgtggagttcctccttcggtatgcccactccgtgatcctttacttcaaaacggtatccgtccttcatcagatggccgtagacctcaatgaggccgtccgcctcggaagctttgaacgcattgtccagcaggttcatgagaacagacttaatcagattggcctccgccctcaccatgccgtcatcatagttaaaatatattttcatgcttttgttgatcacgtacatgtcatacaggtacagaaacagggattcggccgacaccatggtaaattccacctctcccctcctggtgaccatgatgtctaacaggcggaaggacatggcctccaggcgtttcccttccgtgtaaatatagttggcggacataaactgcttttcctcatccagcctgcgggagcgcagggcatccgcataaccgataatggaggtcagcggcgtcttaagctcatgggcaaatgcagccacaaagtcctccctggcctgaatctcatcttccagctgattgatgttatcctccagggcattggccatctggttaaaatccgttgtgagctgtcccagttcgtcgctgctgactttcctggccctgtggtgataatccccggaggccatgcgcttggtggccctggtcagcagacggatgggcctggtcagaaaggatgcaatgagatacataacagccgtaccgcaaagcagcatggccacagtcaccctgcggtagacagagaaacccagggacctgtcccgaaacacctctgacacgtccttcatggtctccagatacagcacccggtccagggcattgacagccgtacctgtctgtatgtagtatgctccatcctgttctatgactctgtatgtcctggtatcctggcctgtccggtccaaaagcccgtctcccccgccaaatccggggctggcataaagcacatttttctgctcatcacaaatacgcagcaggcggccggagcttctgcctcccgactccagattggatgctatctgactcaccgtggtatcctggagcacatcatacttggctggcacattgagggcagctgtctcaaatgcaaaacggagaatgctgctctcatccatggcctggtttacttcccggtccatggaggtctgaaacacgtaattgacaaaataaaatccgctgaacccaaaacccagggccatgacaatcatggtccacagcaggagtttgaacgaaaatttcattgaactacctctaggcggtatcccaccttgtagactgccaccagattattttcccatcccagttttcttctcagccgctgcacatgcaggtccagggtgcggctgtccccggagtactccccttcccacaccttttcatacagggtctccctgaaaagagccacatttttattttgtatgaagagtaccagaaggccgaattccttgttggtcaattccacattcctgcctgccctggtaaccctgcgagcctccacatccacggtcacgtcaccggctgtcagcaggcgctccgtcttattgtatctgcggagaacagcctccactctggccaccagttccaccacgtcaaagggtttcaccagataatcgtccgcgcccaggcgcagtccctttaccctgtcctttacctcatgtctggcagttataaaaatcaccggtatatccatggggcggatgtagctcatgatatcgtagccatccactcccggcagcatgatatcaagcagtatcaggtcaaaaaaccggttctctatgagccggagggcctccaccccgtcctggacagccgtacaatggtaaccgctggccgacaggtttaaatcaatcaaatcacaaattggtttttcatcatctactatcagtacttttatcatggttctgtcctccacccccaatatgcgcgggccctgtccgtcaagcctgccagggtatcgccttcctctaacgcaagtgtctgtttcatgtccgtatcttcgtaaaatccgccggtccgctgatagtatatggaatagcttccctccacaaccgccccgccgtcgcttccctcatagctgtaatccgccagtatgacaatgtctttgagtccgtccccgtctatatcctggcaggtaacgccctttaacgcatagagatgttcatattctcccatgggctggaagctccagacaatatagccctgttcatttaccaggtacagcatgaataccgtgtactccgccatccggtaggtgcccgggacaaccaaaaggcggccgaacttctcaaaccggacggaacggctctgctccgatatgaccgtcatcccgtgggacagaagctcatcctgggcagtggatgtatacagaaactcggtagagtatccgtcccggacaaaagatgtgatgaaacggatgctcttattcatgccaaaacggttcatcttttctgagagtctgtaatccctgtaaaaaccgtcatttttctgaaacagcacatcccccaccttgtagggctttccctgtttaccggcgccctcattggcacaggcggttatgagcacgatatcctgccatccgtccccgtccatatcctgaaaggacacggcggccacccggctgtcggactgcctgagctgacctcttatccggttattggtctccagctggtctgtcttatacgccatggtcccgtccgccctggcaaaaaacagcaccagccggttggactccctgtcaaaggccggtataaaggacacctccccctctcccttcatggtcatggggaatacctggctgtccaccgcttcaaacccttccctttcaatatccccggtctgacccaccgcgttaaggcgctgcctgtattcactgtatgaacgggaaacagcctgggaatccggggcaccgttggatgccccgggaaagcccaggcataagacagctgttgtgatcaggaacaggatggtccggaacgaaaaggcagaatatgtttgattcatcaatggcatgcaccagcttttcttaatgtactattccgattatatcaaataaagatgggaattcaaacatattcatgacctgtgccaaacaaaatatttgaggggatgccgccggttctcaaaagctgcccgaaaaaagaaacttaaggattgttcaccgcgggacgattacacacccctatataaagcggcgctcccatatatccggtgaccgcatataaaaagggcctgtccaggttcatctgtaaagctgtctcacctgaatacagccctgcgaacccggcttctccgttctctgaaaatggacccacaccgttttcattgacgctgaacaccgtggattggatcacgccggaaagtgaaaggctttcgcctgtaatacctgtaaaatcagcccggctgacatcaaatgcatcggtcagccccagaccggccagcgaaggacccaggtccgccgtggtggcggtctggaatttaggaatcttccagtaaattccgccgtaggattcaagttcatcaatcctgccaaacatttccctggtatactgttctgaggagagcagttcccggattgtcactccctggtcaggcagaacaactatcatggcagcattatccgtaagtgagagtgatgcgcgcaggaacccctggccccggtaataagtgccgttccaatgtcctgtcatatactggcaggttatatcctgtccatcggcagaacggaacacatctgttatattgtcctcagtcctgaaacctcctgtccactgggcctggtaattcactgtattcacaagtttcatgctttcaccggaagcggttgccacgtccatggaaatagcctgatccgtctgccagccaatccactgtctgataatggccggcagctccggatttccaaagtccacccggaaaacagacgcatagtactcgttttccgatgttctcttaaaggagtcgttcagcggggccccttccttcagccacatggaatttaccagcttcaattttgtcttttcattgttcctgaatatctgccggtacagacgtccgcaggaagccgccaggccggccggaggctgtgccgtgtgcaaagcctgggccggctccgaagactgagacccgtcaggtgtctgactgccgattcccataagcgccagcatctgggccctggtatttccccctgcgccctcggatgcctgggccagggcatagtacaggctcaccggtgaaaaattcatgttttcccggctgtccctcaaaagcggcaggaacaccctgtaggaaaaccgggatattccatctgtaaactccggattcaccgtgttgttctgggctatggcgcgcatgctgcctgaatcattgtacggtatgggatccgggtccctggaaccggattcacagcgatagccttctcctgacacaccgttaaaaggcgcggcaaaggccgcaggacttcctgcggccagtacggatatggccgtggtcaggacgcctgcggcggcaatggatattatattacgtttcatgattcatcccccctgtaataactgaaaaacaaaaccatttgcttctgatcttattttaccagaatatcatcaggaagatgtttctattttcttaattaatgcggtcgttatctgttaccaaagggagaattccttatctcccaccacagggtccgcggttcccttcttcttgtctatctcatatgtattgatccggtggaacacatccggcttatcctcatatccaactgaaacctggaccatttgattgttctcataatccaccttaaactgcaggggttcttcttcgtcccggtacattcccatctccagaagcttattttccagaaggcgacaggctgcctccgatgtcatggacggcttctcaatccatacgcctgtctctgtatccaggcaataccagattccgtcaatccggttccagcctttcaggagctcctgattttcttcgtagacccactgtccgttctccccctgtatccattcccctgcccaagccggaaatgtacagcccagtatggataccatgagcccaaccccagccaatctgtgtcttattttcatccgatcccgcctcctgttccagagcaagtcttaaaaatatttttaaccatacaccagtatacctcataaacattaactttatataaactggtccgggattccttaactgacgtaacacctctttcttttgttctgcttccttaacccgcttcctcaaaattccctgtatacagctgatagtattttcccttccttccaatcagctcctcatgggacccccgttcaatgattcttccctgttccatgaccatgatgcagtctgcattgcggatagtagacagtctgtgggcaatgacgaaggtggtcctcccattcatcagggcatccatgccggcctgcaccagagattccgtcctggtatctatggatgaggtggcctcgtcgagaatcagtacaggcgggtctgccacggctgccctggctatggctaaaagctgcctctgtccctggctcagactgcctccatcccctgtaaggacggtttcatagccatgggggagacggtttatgaagctgtctgcgttggccagtttcgctgcattgacgcattcctcatctgtagcgtccagctttccgtatcggatattgtccatgacagtacctgtaaagaggtgggtgtcctggagcacgatgcccagggagcggcggagggccggtttcttaattttattgatattgattccgtcatatcggatttttccgtcctgtatgtcatagaagcggttaatcaggttggtgatggtggtcttgcccgccccggtagagcctacaaatgcaattttctgcccgggctcggcaaacagcttgatgtcatggagcaccatcttggatgggtcatagccgaaatccactccgtcaaaaacaatgccgccttccattttcttataggtaacagtcccctctgccttatgggggtgtttccaggcccagacaccggtgcgctcttttgtctcttccagtgtgccgtccttccgttcccggacattcacaaattccacatacccattgtcctcctccggcttctggtccagaagctcaaatacccttccggcgcctgccgctgccatgaccacagagttcatctgctggctgatttgggtaatcggctgggagaaattcttattgagtcccacgaaggcaatgatggtgccgattgtaattccacctatgccgtttaatgccagtattcctcctgccactgcgcacagaacataactcagattgccgatattggcattgaccggcatgaggaggttggcgtaccggttagccttatcagcgttgtcccgaagcctttcattcagcacctcaaactcctttttggcctgttcctcatgacaaaataccttgaccaccttctgtccgtccatcatttcctctatatatccgtccacctctcccagggagttctgctgttttccaaaatgggaggcagatttgcctgaaagacattttgtggcaaacagcatgacacaggccatagcaaaggtaagtatggacagaggtatatttaaaatcagcatggaaacagcggttgccgccagtgtgaccgcagaattggctacctggggaacactctggctcatgagctgccgcagggtatccacatcattggtatatactgacatgatatcgccatgggcgtgggtatcaaaatatctgatgggcagagattccatcctggtaaacagttccaccctcagccgcttcatggtgccctggcttactgtgaccatgattctgttatacgcataggccgccagaatgcctattaggtaaaggactgccatcctgcacagcgcccctgccaggggagaaaaatccggcgctgtattccccgttgacgcctgttgggccaacggccggatatagtcatccaccagggattgtatgaacaccatccccttcagggtagccccggcggacactatgatacaggccagcaccgcggtcaccgcaagtttataattggctgccatataccggatgacgcggcccaggaccctgatggcttcctttgtctccctggcctgctcctgtctgccggtttgttctttccggctgctctgcgcctgtccgctgtcctgttttttccggctgctctgtctgtcttccatcatgccacactctcctttcctgcgttttctgcctgaacctggtcaaagtcccctccgcccctgctctgtgactcgtatatttcacggtatatctcattggacctcaccagctggtcatgggttccgtatccgtttatatgcccgtcctctatcaccagtatgtggtccgcatgctgaacgctggatatgcgctgggcaatgatgattttggtagttcccggtattgccgccccaaaggcttccctgattctggcatctgtcgccgtatccaccgcgctggtggaatcgtccagtatcaggatcctgggtttctttaacagcgccctggcaatacacagcctctgcttctgaccgcctgacacattggttcctccccgctccaggaaggtatggtatccgtgtggaagacgctctatgaattcgtcagcacaggccgcccggcaggctgcccggcattcttcttccgtggcatcctgatttccccaccgcagattctccagaatcgtgccggaaaacagtacatttttctgcagaaccactgccacggagtccctgagcgtttccaaatcatattcccgcacatccctgcctcccacacatacgctgccgctgtccgcgtcatagaggcggctgattagatttaccaggctggacttgccgcttcccgtgcctcctatgatgcccacagtttcaccggaccggatatgcagctcaatatcggacagcgcctgcctgcccctccccttgtctttgcctttgtcccttcccttatctgttcctccagcgtcctccttacccttcccataggaaaaacatacacagttaaaatcaacgcttccgtccgccacatccatgacaggccgttccgggttgcggatgcccggctcttccttaaatacctcctcaattctccttatgctggcagcactcatggcaatcatgacaaatatcatggacagcatcataagagacatcatgattgacatgatatagctgaacagggaggtcagctcgccgctgctcatagttccaatgacgataaacctggctccaaaccaggatacggccagtatacagccgtaaaccaccagcatcatggccggattgttaaatgccagggtgccttctgcctttacgaacaggcggcagaggttttctgctgccctggtgaatttttggttctcataatcctcccgcacataggccttcaccacccggatgccggaaacattttcctggacccctgcattcaggtcgtcatattttgtgaaaacaacgttgaatgtcttcctggctgccatcatgatgcttcccagaatacatgccaaaaacagaatggctcccaggaaaatcatgctgagcctgggactaatcatgaaggacatgaccatgctgcataccagcatgaggggcgccctgacagccaccctaatgcacatttgatacgcgttctggatattggttacatccgtggtcatacgggtcaccagacctgccgtgctgaacttatcaatgtttgaaaaggaaaagtcctgcaccttgtcatagattccctttctcagattacaggccagaccggaggatgcgctggccgcgtactttcctgccattgccccggatatcaggcttataaaagccatgacaatcataattcctccataggtatatacctttctcatgttcccttcctgaattccctcatcaataatcagcgctgtgataaagggaagcatgacctccataattacctccagggcggtaaagagaggggtcagaatggaatcttttttatattgcttaagctgtgctaaaatcgttctcatattctgtctccttatatagtgtctccttattttttaggtattacaactgactgtgccattagccggtaacggttctgagcacatgcaaaatagttaactagctaataattagctccctatatttatacctcatatcctgttgaatgtgaaattcaaatatgttataatctataaaaatattttattgtttactattagtattgtttttagagtcaatcgaacaaaagaacattaacaaagattgaaaagaaacagcaacagaaattcaaagaaaattcaggaggcgattcctatgaatacagtgcagttagaatgttttctggccgtggcggaatatctgaatttttccaaggcagctgattttttaaaaattacccagccggctgtaagccatcagattacatccctggaggacgagctggggaccaggctctttgtgcgtaccagtaaaaatgtaagcctgactgaagccgggctcatgttcatggaggatgcatccagcatcctgaagattgcctgcggcgccaaaaaacggctgggcataggaagcaatgacgttctgtttctcaccgtagggtgccataaccagtcagagttagatcttcttccccctgtcatacgcaggctggcagatcgtttccccaccctccacccctctgtgaaactgattccgtttaagtccatggccaatcttctggatgaagagcgcatccacgtcatgttcggcttccagcaggatgagcagaagaaacccatcggcttattccataagctggcccggataccgctggcctgcgtgtgcagtgccggacatccctacgccgggcgcacctgcctgaatgtggatgagctggaggggtccatagtcctgggtgagccccacaggctgcctgccaccgtactccagtctcaaatccgtgcttcctcctcctgccatccttcggagcttttctttgtggatacctatgaaagcatactggctctggtaagggcaggccttggatacagccttctccccttctatccgggcagtgataagaaagggctctgttatatcccggtaacgggaatacctccccttgcttttggcttgtatcataaaggagtaaagggaaataccatactaaaagaattcatccggctattggatgaggaggtggctgccggtgaattccgggcatgacaaccctgcatgtttttcagcaggaccctgccatgttctccctgaaaaaccgcagaagcctcatccttttctgtactccacggtctgtcccttcatggtggactttgcctcgtacagggcaatgtccgcacatcttaccagttcctcaaatgtacagagttcccctccataccaggcaatgcctgacgaaatctggattttcagctgtattccgtcaggcagaacggctgggtgtttatccagaatatcatagaaatccctcaattgtttcctgacgcaattcctgtcctcatagccaaacaacagaatgaaaaactcgtccccggaacgcctgccaactatggcatggtcctccggtatccctttcatgcatactgcggtctctctgatatagatatcgccgctttcatggccgtatgtatcatttactgacttaaggccatctaaatccagcataaccattgcggcagttcccagattgacagggccgtttccgctcaggcccggcatttctcctgtctgtcccggcatttctcccgcctgttccagtatggcctctgcctcccgctggaaagctgcccggctgtaaatcctggtcaggctgtcatggtccctctcatatttaattctctgttttttcatcatatccccggtcacatcctcaatgattcccagggaatggccgtggcgcagagacagggtaatccgtacccagcgctctgtttttccgctgattctgtagattccgttttcctccggcaccggacatctttgcatatccgacagcctggacagaaatatcttctcatccacatacaaatgattctcgtcctcacatggaagttccataaggggaaagatctgttttgtgacctgtactccatatccgccgggactgtactcaaaggcaccgatatgaaggcccagaaggtccatgatttcagacatcttaagtgtgttgtccagcagattctgattggatatctccactgcctgagacaacaaatccaattcctctatcccggtcctctccagcctgatttttctggtataatcaaaattccttactttggcggccagctttgccacaggttccgtgattttcctgctgatgaacccggcggccccggcacccagcaaaagggataccatcaatgtcactgcaaaaatctttatgatccggtgaagaaaaccatacagtgcatcccctctcattaatcccagaaccacccagttcccgctgtcatatggaacattctttgtgccgtataaatccaggctcttaatacagccgtatatcttttctcctgtaaggctggatacctgacagatagagtacgtttcgtcctcctgctttatcctgagcagcggttcatccccaaaaagtctgttctggtactcgcccttcttgaccagaacaaacagctcctgcgggttctcctgcattgcggcaaccatgtaccccggtgaatcctgggcagacagctcgttggcaggcagcagctttcttatatgctccagggatatctccaccccaatcacaccgtggacctggccggtgcggtcaaagagcggaacggtgtaggtaatgacaggcacatcctcaggtgtcatgtggaaaggccggctccagtatcccagcttttcataatccctggactggccggccgcctgaaacggcatatcaaaaaacttcctgttttcttcattcaatgacaggccgtaatgccaaacgctgtccagaggaatctggtatctcctggatacctccgcaggtcccattacctggaacaaatcactgttgtccgcgctgtatgtctccgggtcatagtccctgaaatacagagccggcatgctttttccctgccccggttcatccagtatcagaaatgtgcccgtggtaccgctgacatgcagcatggatataagggtatccgcagagccaatcagaaatgactccgcatccatttttccctccccatagccgctctcagacaattggtcggacaattcctgtacatagggatgaatattggtccaccggttgtcaatctggtcctgaatggagctggccctgagggtcacggtggacgcaaatgactggtacgccgtatccctggtctgcttcaatattccgcccgctatcagcatccccagaaccagcagagactgaagaatcaccagacccgcagtaaaggcagagcattttgatgctatggactgcttttgtttcatattcctcatcagctccctaataatttagcggcattatcctgccacccttcataccattcctggaaatgggcctcatccgtgacctgggcctgggcctcttcctttgtcatgccggccttcatcttatcctcagcctccagacgggcattgtccacagaagcctccatatattcgccgtaaaactgtctcatctcatagcttccctcaaagggaggattggaataaaagcggtattcagagagcattttcagagtagcctctgcggaccctcctatcgtgggattatattccggcgtaccggaataggctgccatagccttggcatatccctggttcagggaactgttctccaccggcagataaccgctgttcaccgcaaaatccagattctgctcctcctgggtcagccatttcagaaatacggccgatgcatactcatgggtactgtcgctttgtgcaatagagaatccggccccctggaccatggcgcacaagtccccgtcgcggaaacagggatatggaagaacactgctctcaatccggtagatttcattctgattcagggtcacttcctttggaaaataaaccgcccctgcgctggagcctacataagccagtatatcccctgtcttttcatcatcagaacggaacttgcccagatttgcataatagccctttacgtagggcacatacagttcatcccacaaaatcctggccaggtcctggtcaaaggaaaacgtcacctggccgtcctgcagcttataaatatcatttcctgtctgcacggacgcaacaatgatgtagttggccaggctgtcaatgcccagaaatgcctttccccccgaccactcgtaataggccttggctgtctcagccaccccctcccaggtagaaagacggtccagccggacccctgtgtcccctgcaaacctgtcccagtccgtcttattcagaaacagattttccgtagagcgcacaacaggaagaattttaagcccataattcccgccgaagctgcagtcctgaagaaaatccgcccggtataccttcagctcatcctcggaaaaatattgattcaggtccacaagcttgcccaacacatcaatgcggtaggcattttccggatacgctgcaaacagattgggcatggcgtcagctcccagccttccgatggctgaattgtaagcctcctccgccagctggtttacatctccatagctgacactgtccacaatgattcccatttccgtgcccactgtttcattgaatctggacaccagattgtcaaaggcctgttttgtctgcccgttataataattccataccgtaatcataaccggctgtttgggattcagctgatacctggcttcctcactgcgtgaacagccggctgccatccctactaacaggaatactgctgccgcccatgccagtattcctccctctctctttttcatacaaatcctcccattcctgacagactcagctcaccgcgtcccgtccttcccctgaatcaatcttcacactttccagactaccgtcatcccgcttttccacccgaaggacaaaggggaagatatcatgctttgtgcagagccagaaatcctcctgaggatagatttcctgggtatgaggattaaagaaatgttcgccgccggctgtcttcagggaccgtatttcctcgtctataaggcagggtctgccctccagaagacatttgatataccgggcgcaaatcacatcctcccttgcagtcctttctcctccgtttcccatggctaccagggatactgtctccggctgtcttctgctgatataatcggcaactgccctggcattcaccaggcttccggtcagtatctcctctgcgtgtacggcattcacgattccctgtgttcccgcgcttgtagtatgtacgatttttttccctgacaagtccgcgtcccgggtctgggacggtgaatttccatagtcaaagccctcacacctgcggccccggcgctctccaatgagaagatattccggatgtacctgtttcatatgcctggcctcctccacgcttccggccgggaatacggcagacgccccccgggcatacagatagcactccagggaaaaagcccggaacacatctatgataacggttaatccctctgctttctttgctccttcaatcaattccaatattctgatttccatgctgtttttccgccctattctattgacctgctgttagtttattgttggtttattgttttttccattatacagcatcccggagctaatgcaaagaaataaagttgtggaaatggaaccgggattcccggctgcccttccggatctcagccatcccgctctccaaagactcctatggtctgtgaatccgctccggaaaataggagtacaggcataaaaacgccaggaaaaccgcgcctaaaaacactgctgtataccggatggtactctccatatccaggacccggtcctgttctgcctgtacggccacggtccagccataaggttccagacgtttatacaccacataggttccgtcctcaagaaggctgcccgtctcctgattcatggacgggagaagggacgccatactgtccgctgttttcccgctcccgtcggtatcaacacggtaaatgcatgctccgctatcatccataatataaaaggatgcgcctaatcccaaatctatatcggaaagcgcggactgcagcctgcttacatccatgtccatataaaaatggcccagacagctccctatggtctttaaggaggtgatatccttataactgcgccggaaggtaatgacctgactcccggaatcctgaaaataatcatccatatgggcgggcaggaccgaaaaatctccttcctcatcctctttcccggtccaataccggaacgcgtcctcatccagtaccttatacgcgttcctggtagcataataaatctgccctttccggtccttaaaataaacgctgcgcagcctgctgtccctgtccaggaaatcactcagaaggagggtgatttccattttcctttcctcccggccaagaccgggggattttaaaatctggtacaggaacattccatcatccgtggaaacgtcatagatatgctttgtcaggctgctgcattcctccaacaccgcctctgtattgctgcctccatagctcaccatgcgccctatgtcatccagcaccacacgttccatattgcttctgaaatgtcccgttaacgccgtgccggcagccagaagaggcaccaggcccagaatcacaaaggatgtggccagacgaatcaatctgtttacttttctctgcatcacggctcctcccagcgttccaacatattatctgccagggatgaaattgatgttccgccccacagcgtctcaaccagcatccggtcatagcattcaataaaaccatccggcggctgggcatccttaagcagaaactccgtatgcacaggatttccctcataagcagcctccatgattttcctgtccggtgtgtccggcatgttcacccggcggaccgtcacagggttcccgttcatgatttccaatatgatttcatatacgccttcggaatagcagaactgaaggaaccggacacacgcatccatctttttcccatccccggcagtcagcgacgaaatcccccactgcacacttctgtcgtccattgcatagacagtcccgttctttccgggaagaaagaagaagcccaggcggatctgaggattcaggttctctatctgctgcagcatctgaggccctgcatacaccatgaccgcctgccgggtggatatggccctggctgtctcacggtctgtcactgccctgtaccgggaattgatatatccccggctggccagatcacggaaatcccccagcatctccgctgccttttttttggtccagcaggcctgtccgtcccctgccgcaatgtagttgcagaacaggtaattcccccaatatttcatatgccggtcgccggcagctcccagggcaacggcatcatatcctgatgccttaagggtggcgcacacccgaagaaattcctcatatgtgcgaggtacgcaaagtcccagccgttcaaatatctccgcattataaatcatccccagggtggtggtgtaaaggggaacaccatagcatatgccgccgcaggtaccaggattctccaccagcgaatacacttcctccggcatgggggccagaagccctgcctgtacaagggagtccgtctccctcagctccacgatatcgttaaactctccctgggcagccagcacttccagctgcctggcatatgtctggttttctgcttccggcatgaaatacagctccaccttaatgtcctgattagatttcataaaagcttctgccgcattctccattccgctcttccatctaatgtcccctgatgaacagaccacccgtattttcacctctgggtcctgacggccgacggacccggggggcactgcggggctgcatcctgtcatcataaacaacagaccagccaaaagaaggatgctggctgacatcctgctcacggctggtctgctgtgggattttgtggtttcaaagctttcttcccgccaatttttcttttttctatccctggctctgcggccggttttctcttctgtactcatctgcacccttcccatatttccccctaaaaagctccccgcactgccggaccttcctgtatccagctgcttctgctgctttatatatcgttaccgccgcatattgacccggttcctgagtggttggcagtaatacggataaacgcatccatctcctttgtcagccacttattcctgttataaataacctgctgatacatggccagcctgaagtcagccacatcaagcacagccagctccccacgttttacatattcctgcaccgcaaacaggggaagatatgatatgccccggttcttccttatcatccttatgatgaattccgtattgctgatttccaaaaagggagtgaggaccattccctgtgattccaggaaacaatccagctcccgcctgtaattttcattcttttccgtcaggaagaacggctcgtccatgatttcctccaggctgattaccctgttccccccaaggccgcaggagggagaagccacgaacacaatgggttcccggacttccatgaccttattccaattatcattataccttggccggtccagaatgtatatcaaatccagctggttcctctccatcatatcaatcagctggttgggcgtggaggcagtcaccttgaccggaaccctgggatggctgctgcgaaaggaattcagtatctggggaagctttgaaaaacacagggattccagtgttcccacatgaagggggctgcacagctcctcctcgctttttgcaaattccctggcacattttatatcccggataatttggttggcatggcccagaaactgcctgccgggcgctgtcaggtaaacccgtttccccatgcggtcaaacagttttactcccagctcattttccaaaaggcgtatctgcacggtcagggctgactgggtatagcctaaaacctctgctgccctggaaaagctttcggtctgggtgatagtcacaaaggtctgcagctgtcttaactccatttaactacctcctgacaatctatgaatttaatttattatatatataaaattcatgaatttgatttatttatcctttatgatacaatgcacttacgcagatgtcaattacctgggttcaatcaaggataagcctctgcagtaccatctgcaaaaaaagaaaaggatgagattacatatggcatttatcagtatatttgacgtgttgggcccggaaatgatagggccctccagttcccacacagccggcgcatgctccattgccctgctggccgggaaaatggcggacagtcccattacacatgtggaatttaccctctaccagtcctttgcaaagacccataagggccatggaacagacctggcgctcctgggaggaatcatgggcttttccacagacgacagaaggataccccttgcatgttccgtggcagaagaacggggactctcctaccgtttcatcaccgatgacactgattcggacacccaccccaacacagtggatatccgcataacctgcttaaacgggcgcacttactcggtgcggggcgaatccctgggaggcgggaaggtacggatcagccgcattgaccatatagacgtggacttttccggcgagtacagcacactcatcatcatacaccgcgaccgcctgggtgtcctggcccatatcacccgctgtctcagcgagggatatgtaaacattgcctttatgaagctgttccgggaaacaaaaggagacagggcttacagcatcattgaatttgacggaagcctgccggaccatatggtatcacggatttacgaaaacccggatgtacaggatgttatgtttataccggtgaagggagaaaacgaaaatggattttaagaatgcaaaagagcttctggacttctgccaaaagctgaactgtcctatctcagatatcatgaaacagagggaatgcaccttggctgagaccagcctggaagatatatatgcaaagatggaccatgccctttccatcatgcgtgaagcagcctcttctcctatccaggaaccaaaaaaatccataggggggcttattggcggagaagccaggctggcagatttgcaccgggccagaggagccgccatctgcggcagcgttctctccagggcaatcacctattccatggccgtcctggagacaaatacatccatggggctcattgtggcggctcccacggccggatcctccggcattgtccccggcctgcttctggcgctccaggaagaatacagcattcctgacagcagggtaatagatgctctgtttaatgccggcgccatcggttacctggccatgagaaacgccaccgtggcaggcgcggtgggcggctgccaggcagaggtgggggttgcctcggctatggccgcctcggctgccgtggagctcatgggaggaactgctaaacagtgtctcaatgccgcctcgtcagttctcatgaacctgctgggcctggtgtgcgacccactgggaggtctggtggaatgcccctgccagggcaggaacgccgcaggcgccgctgttgcgctgaccgctgcggagctggccctgagcggcatccgccagctgattccttttgatgaaatgctcgcggccatgtaccgtgtgggaagacagctgtcccctgacctgcgcgaaacagcgctgggcggatgtgcggccacgcccacagggaaggcgctggggtgcagggcgtgtccatgcagtccgtaattatgccaactgtctcattttttggaatccttggaacacgggcctcccggtgtagaatttaggacactctatgccgcggagtacccggacacagcggccagctaccctttccgcctccatttcctcactaaacgcttcaccccactctctcctctgcgccctttcagcagccccactcccagattggcgctcagaagaattccggcagagcctgcaaaaacatacacgaaccgctttacgcgtccatgccggccgccggaagcagaagaaccgtccccttctcccccttcctgtccgtctccccctggtcctgtttcaacctttccggcattagcctggagcgcatcaccggcctcttccgtattgtctccgttttcatctccaggcatcccccgccttccatatgcgtctctgcccagtctgtttcgttccccaaaaagtccatcctcaggatggtctgatgcagacgcatccccttgcgttacccgggccgtatccggcctgtcagtatccggccggatgctgtccggctgccctgtggcaggaatgccaaaaccgcctccccacaccccggctcctcccggactgccctctcccataccagcctggtctcctgccatctctcctccgccggcgctatctaccccgccggcgccatttaccccgccgccgtttaccccgccggctccaggtcctcctgaggcattcccggaaaccacaccgccccttccggatgtaccctgtccgcctccgcctctgttgcccccggaacttccgtcgctgtcagacgacggctttgtggcttccggcaccagactgacctggcattttaccggatcggaagtcatagtgcgcaccgcatccccatctcttacctttagctggattttaaaccatatgggtcgttttcctatgttgtatttaaagacaatatactcataggcctggccggaagcagcattttgttccaggtagttcgtatattccccatctttccctgtccatgctgccatctcatagctgacctggtcaaaactgtaagaaagatacagtcccactgcattatcaggaattcccgcaatccgtatccgcatcacagcgtagccgtccgcgtctgctgacagtatgtctgccgcttctattttcattgacgttctgctctgcaccgccacgtccagggatgcccgcagatcgcttgggttgcacaggttccggtctgccagagcctccttggaataatttccccataccctatacacacccgcccggttaaaatccacggaggacaagtcccactgcaccggtatttctgcccactcatatttcccattgtccgcctgataaagcacaaggtcaaaagcagggtactcctcctttttcggcggttctccctccgcgcaggccacagtgggaacagtgctgtcgggatttggcagcagcggccttgccgcaggcacgtcctctccccagctttcgccgggcggatctgaggtttccggctctctattttcatctctgattcctcccgccagatgaaaacgggaggaaatctcgtattttcctcccgctttgaccaggatgtgatcggaatacaggctttcatatgtcccgccctgagacagagacagtctgcctccgctctccacggtcatgatttccttgtttcccataaaataaaggtccgggttgtccactgtcaactgccctttattagcgatacggatggtaaaatccctggtgtttaattcccttctccggcctgcgttcccctgttccatccccagctccaccttaccgtctatcaccaggtccgcggtaagaacggcgaatcctccattggcactgtctgattgataccaattcaggaaatcctccttgcctgcgattctcgcaatagcaatgggtcccgccagacagaaggacggtttacctgacagtatgcctgtgttcacgtctgatacggcgatgaaacatagtaagaccagaaccgcaatccatgtttttcttttcatgtcttttgttttcactccagcttcccctttgcaatataaatcccaccaattcgccctgtctgtttccattttatcatcccggcatatttcaggcaatgtgattctgaaatggaaaaggcatggaatatcaggctgtcttggtgggaattatatgatatctgtactgcattctcttacagatgcaggttcatctgattgtttccattctggaaacgatggctgtactggcgcaccatcctggagagcatcaccaaagatgcgggaggaaacattccgggcaaatttcatctcatgggtgacaatcatcatggtgagcccttcccctgccagggcgcgtatgacggaaagcacctcacccatcatggcaggatccaggacggatgttggctcgtcaggaatgcttccgtgctcccggtaaattccacctgcacccgggcatcctgcttcaccaggtcttgtactccgggccccctaaaatggaagacggaccctctgccccttatacagccagcaaatcagcccatagagtaccaatggcatagctataccgatataatcatagtctgattgaatcaacaggttgaacagggcatgcatggtgatggaaatggacagaagcccgaaggttccggtgtagaacagctttttttgttttttaacgtatgtgattccggttcccgccaccacggtgcacagtccgtgcatcaggctggctgagaagcctcttgccgtggcccacagtacggttactgcccccacgttgtcaattaagatcatggaattttccagaatggcaaagcccacgcccaccgccatggcaatcgggagcaccctgtttctccggtcatccagcaaaaccgcgtacaaaagcaccggcattgccttgagcaattcctccgtcatgggcggaaccagctcggaaaagcttctggcgctcagtcctgtcacgggatacacgatggtattgatttcataggcggacagggctgtaacggtccccagaagcataaaacccactatgcagcgcgacctgatctccagcagcggaagcatcagaagcatggggatggtcaggcagagaaatattatataaaccatttgcgcacccccatttcggccattggcagcagcgtcataagaagcaccgacgacaggacagacccggccgcccggatatccaaacctgaacatgcaggggcctgtaaaaggacctgcaccatgcagaatacgatgacgcaggcattgtaagggcgcatcacccggatgatacccaaatccacatccggcaatatcaggtgcttgatggaaaaatacagggtcggggcaatgggcaggcataggagggcataggtcaggcaggccccgtcccccagggtccgcaccgagtgggcaagcagcaccagcaccagaaggggaccggaggcagcagccagcctgtatccccggtatctggcctcgccgccgtccgccagccggttgatagcgccatagtaggaggacagcaggaagaaataggttcccatgtaacccaatattcccacatgaaatccctccggttcatggccatagaccaatgcatagccggccgtgaacagggttcccagcagataactggccatggcgtagagaaggagcttaaaaaagaggggctgctttctgcgtatacactcccatcccccgtagagtacgcacaccagggcggctgccagcttcaggccggtcacgaatgggcctcctttccggatccctggcctttctttttgagaattccccacataacagccattccgatgaacacgccgattatcatactggtggcaatgggcgctgtattcacagctcctccatgctgggaaaaaaggctctgtcccctggtaatgccctggaggggcttatacccgccctgaagggatgaggaggctccctggctgtaactgttatactctcccataagctcctgcatctttaccataagggactgaacctgtgcgccggttttttctatataatcctccaggccccgtataacagacttccactggtccgacgaatacagaaggccctggtttgacttggggcatgatatcttattggtatccatgtagaacttcatcgtatccggcatgccaatgctttttctggagctctctgcgcttttttgtatctgccgtgcctgggataaaaagctgcctgccctgttctgatcctcctgaatgcggtttatctcattcatatagggcgtcatggtatctttggtgctgttggccagctgcatctggagcctggccaactcaagatttatattggaggaactgcctcccccaaagtccgtgccacctgcccctaccatggccccggtcatggacgcgccccggctttctccttcctctgaatcaagcccgggaccgcccacgtccatcggctttaaatcctccaccagcttctgcacatcctcccacggagcgccttcctgtattttgtccagtatatccccggaggcggcaatgcgttccgctatttcccttagaatctgatcctggtctgactgttccgacccgtaggcagtaaacgatatgagcgtcatggatgccatgcaggcaagcagacatttcctgatatttatcttcatattttatcttcctctctcatgacccttcttcctttgcccaatgggtcaaagacgtttcatcaatgtcaatatattacagccgtccctgtattcataaacaacatcatccatggacttcttcaccatgaggattcccagtccgccgatgtcccgttcctcagcggaaagggtggtgtctgcatccgacttggccaggggatcaaagggcttgccgctgtctaaaaactgaatggttacctgcaggggatttcctcccactgcacaccgcaccgtggcctgcccgatttcggggtggtatgcataccgggcaatattgacatagatttcctccactgcaatggaaatctgcatctgaatcttcatggaaatcccctgtgcctccagcgcctgttccacaaattcctgtacatgctccagttcctccaatgcggccggtaccgtcaactccatcataacgctccctcctctgctggctgtccccttttttctgacagctttaatttttctgacagctttaacgcaagcatggttatatcgtcaaactggggcgcgtcccctgcaaaagcgtctatatccgccttcacagcaggaagaagttcttccggcgcagcatcctcatgagcggcaagcacagacaaaagccgttcttcaccgtagagttcattctccctgttggcggcctcggtgacaccgtctgtatagaggtacagtgtactgccgggagacaggtccatttcacctgacttataccggattccctccattccggccagcacgaatcccggcctcagcttcatgtatccgaagctgcctcctgcctgacgcaccagcggcgggttatggcccgcattgacatagaccatgtgcccggtggcgatttccagaacccccatccatgcggtgacaaacagcccttcctcgttgctctcgcagagctgggtatttacctcgccgaatacctcagccggggtggcgcctgcctgggtgtggtccttgatcagcgtctttgcgatgaccataaacagggcggccggcacacctttgcccgacacgtccgcgatcactactgccagatgtccctggtccaccagaaagaaatcgtaaaagtctccccccacctccttggccggctgcatggttgcatagatgtcaaattccgaccggtttgggaaggccgggaaaatgcccggcagcatgctggcctggatatgggtggccacgtccagttccgccccgatgcgttccttttccgctgtcacagctgacagattctcaatataactgtatagctcatgggccatgtggctgaaggcttcccccagctcctctatctcatccccggtctttacgttcacatggaaattagagaggtcatccatctgttcgctgacaatggtcctcgctgcctgactcaggcggtttaagggccttaagaccgactggcggataaagaaaaaatatcccacgataaagacaaggaggactgccaggatgaccagcaccaccgcagctgcgaagctccctacctgtctgttaatcatgtccatggaaatatccacgcaggacagggccactggccggcctgaagaatcccgaatagccacataggcggaagccagatagccgtactcctcattatctgttatgagaatggtgtcctcaccatccggatgcagataagcgccccccatgatttccctgccgccctgataatagtcgtccacatcccccaggctgcatactccctcctcccccgtctttcccacatcccatatatagtacatatggtcctcgcagggaatgaccacgtaaaaatacttgatgcctatggtttccttcatatacaggagataacggcttacctggtcgtagtagctgtctgtctttcgtgtcaatgcatagtccttaatggtgtctccgtcaatatactccgcagctatcttagcctggtcaaaggccatcttggtgtaatatgattccatgctgctgcggtactgccgtgtgatgacaaagcacagggttatcatcaggaccacggtcattgcaatcagccccataaggaacttaagctgcagctttcctttttttctgcttctcatcacgcctattcctcccacaccggcaccaggtccagacgcagatgcccgtcagccacgccgtacagcaccctgttctcacggacaaacagattatggctgtcatcctgccccagaagcacgcttcctgccgcaaatccatccacatagcagaaacgtccgtctatacacaccgttgtcatcttattgaagcaccggtacaccccccgggcttcctctaccgtcatgccgtgattcagggccagcgcttccttcttcggacggttccagtagggaagcttctccttctggggcctggcattggtccataccctgtcaaaatcctccatcagctcttttaccatggaaagggcctggcgtccgctctttaaataaatatccacgctgtcattacccggctgtatgtcatacttcctttgggccaggatatccccccggtccagggactttgcaatcttatgcatggtcacgccgcttccccccagcccgcgctccatggcacactcgacgggatagtagctgcgcccctcaggaagcaaggagctgtgaatgttgacgccgtaaaaccggctgtcatccggcacaggaatcttgtggctgtattccgccacaaaaaacaattcacagccctccttttccatataggagagcatctcatcttctgtaatctgtccatagcagacaggtatgcctgacatgtgggcaagctggactatattatgctcattaaaatagtcctcctccatgtggtatgtatataatgccagaatttcatggctcagatgcaggtattcaaatacgtccaaaaacacatctgacccaaaatatactattttcactttaaccttccttttttatccttcataataatatccttcttatatatccttcttaatttataataataccgtcctgatttaccttgcagccgccaaccacggcattcactgccatggaaccgtcagcgttaaaataccgccagtgtccgtccacattcttccatccgccggagaacataacaccgtccctgccgaagaaatagattttcccgtcaatctgccgcaggcccgtgtacatatatccccgcctgccgtcatacagcttgtgcagataataccattttccgccaatctcaatccatccgtccttcatataacccttaggatcgaaatagtaccagtcgtaacggccattgtaatacagatatgcccagccggcgcttggccatgtgccgttgctgtaggcgtaccaccatccggtgtcattctgcatccatcctccttccctgacagtacctgagtcatgttcagcctgtaccgctcctgctgtttcttctgttttctgggtataagcgattgcgtaggttgaaaattcatccgctcttatggtcagtgtctgatgttcctcctgatacgtattgtccacagcagataccgttcctccatggaccttatatacaaagtagggtgccctgtttcttatctcctcagggagcggaatcacaatcgtgagttttttgcctttcaggtccggtacaggcgtctcatgatcccctgccgtcactccggcggcattttttacggtctttaacacctgcaaatccagatacatgcccacctgccctccgggagccatctcctgggcaatgcgttctgcatcctgcgccacttcatttctgggtttattctcgacccggagcttaaattccacagtaccgccgtccctgactgcatctgcgtcagcttgtgtatacaattcactgtgaaacaactcatttaatccgccggccacaacttccggagtatcctcagtggcaatctcaataatgctttgcgtctttcctatgctcatctgtataccggccacactgttcccgctctttatttccacaatctgcgtaacacggtagtatccgttattagctaccagattgtagaatccgtcaggcagtccctcaaatttgaattgtcccggtgactgaaggggacccgccccggcccggaccgtattgccccgttccagcgttacataaatcaatgtatccgccataccgctgttgtccgtcacagtaccgcttatttcacccaggggaccgtttaaggcggctgtcctgaaacgcactaattgttcatgggtttttattcctcccccaccgttttcctcatatgatatctgcatcttcacctgataatccgtctccggatccagtcctgccagtgctgcttttacagagactgtttccatgtccgaatcctggatcagctcatggtttacaatctggtatccatcttctgttccggcctttttatagctcaccgtcacctcttttaacggtacattgcccagtaagatgatgccctccagcatggcgctgtttggggtgatatccttgggcgctgacaggctgagtacgggattgcgtactgattccactaaaaatccgcctgttatgacttccggcattacctggtaattgtccgcatctccattgacctgaatctgcgtgattcttatatcatagcttcccgccggggcctcctttgtattgccctcgctggaaacaataagcgctgacctgatggatgcttttacggcatctgtaaggccttcatctcccggccatgtaactataaagccgctgccgccaatgggatccgactgatatactttgcgccctgatactgttatggaaaccggcttaggtttgatgatataagatatggcagtgacagaatcctccgccagcccatatttttgcgccccgctctccgtaagcgcgaatacggcagtataggagcctgcgctgacaggcgcatggctgaccggtacggactgcccgctgtctgtggtccgggtatagtttacggtgtaatcttcttccgtcaggtccgccccagcagaaacagcagaagctgccttttcctcccctgaatagaccaggtcggaaggcgctgacagggtaaccgttacatccactatcggcgcagcaccgtcgatacccgctgtaatctgtccgttttcaacgactatttctcttgttacagcctcgctgatagcgcccgcgtcattcataatccatacattaacaatgtaggtaccgtcatccggaaactcggcttccccaatcacccctgtgatggtcttctcgctgccgtcagccagtacactggccagattcctctcctcctgccggggctgcccgtcctttttaatggtatagtaaatggaatcagtccgccctgctttatccgtaaccctggcatctaccttaatgctcttttttccttccgcctccagcgtaaagctgaaggggtcttttgaaagtacaggcgggtccgcaatttcccctactgagaaaagaacagaacgcgtaatacgttcgcccggggagagctccatatctttccatgagaaggccaggccgctgtcatctccgattagatcgtctgcgctggtatcgttaaattgattattctgtctttcgccataatatccaaaccacatggtagatatatcatccgcccccggcgcctttttacatgccagtgaaaactgctgctgactgcctggatcctccatcctaaatcccgttccggttctgtaaatagatgctgcgtcattgcttccaatctgaatatctgcatttaccccaatacatacccgttccatagtcttatctgacacatttaccagggtatgagtcaccttcagatattttccgtcgctcacaaaatcagcggaaatccctgctgccaatatctctcctgattccagctcaacaaaaaccggttcacgttccaaatttttaatggacgtgcagtctgaaaattttgtaggttccttacctgcgcagacccccaggtaatatccgttgttacggtaggtggtttgtacattcttaccatcttttattccatgtacatcgtaattgcctgttgatgcagaaagccagaatgatagaacaccattttctgtctccacaggttccagcccatggctcaggtctgaagaaaatgtgactttgatactgggatactcactcttgcatacatcatacaacgctcttcccagttccaattgatccgttctgataataacagaaccggatcctgtgatactatttgcaatcccctcaggaacccctgtattccggggcagagaaaccaccagcctgctgccggtccccagtgcattgctcccaatagaggttacactctccggcacggttaattcatgtaactgtccacatgcgttaaatgcattttgacctatacgtgctgcctgacccaattccacagaacaaatggtctttggaaagatggaaccagacgaaacgtccggcatatctgctatcttttctttttctactgaatcactcataataaatgtctggagcgataccatattccgcagataatgccaatcgctttccgaaaaagtacctcccagaatctccagggaatgaatattgtcagaagtctgatccttcaaagcgtcttccagtcccgttccagtcagttccataccgtcatcaaccctgatgctgataacttgttcctctatcgtattcaccagtttcatattgccgaaaaatgtgtccaggtccatcagcttccggtacagctccgaatcaaattcatccttctcatcctggctgagcgtatcatatgccttctttgcttctttctcctgctccattattccttggatatcgggaatctgggatgccgtggccacacttatccgctcaaccaactccactatttcctccgctgacggaagcgcttggattttctcataaacagattccatggcggaagtagggtatataatcacagcatctgtaatttctataaaaatcattggcagctctgcatccgtatccatatcataacggctgcttataacaggtatgtagcaataggtggttcctgcttcatcctcgggggagtaagcgtattctccctcatccggttcccacgccttcaccgttatctcagtccactggttatccgtttcttctgtgttgctgttctctgtattcccggcctctgtattcccgtcttttacatttaccatttccgctgcggtctctgtatgtgcttcaatacttcccgttttaccgccattctcagtaacatccgcacctgtatctgcattctccggcagacctgcccatggtaccatccggcccataatcacaacagaatctccaaaatcattattatccgtactgtcatagccatcagcattaccggtagatgtagatatggaagccccggaatcatcagagctgccactatctgctgatgcgccatgtgatgtatcctggttgccttccggcaccgctccttctgacgaactctggttcccttccggcttttctccttccgacggactctggtctccttccggtgtctcaccttctgacggcccctggttctctcccggctcctcaccttccgacggcccctgattctctcccggcttctcaccttccgacggcccctgattctctcccggctcctcaccttccgacggcccctgattctctcccggcttctcaccttccgacggcccctggttctctcccggtgtctcctcctccgacggattctgattctctcccggcttctcaccttccgacggcccctggttctctcccggagtctccccctccgacggattctgaggctctcccggcttctctccctccgacgggttcaggttctcttcgggcatctccccctctgacggtttctggaccccatccggtacggctggtgttacggctgacgttggctgttccggtttttgttcctcagcatcatcccggtatgtctttaccatcaaagtatcgggaaacagcttttcaaattcctcctggctggttccttcaggcaccttcatggaggagagttcctccggcagttcctggaactcggaaataattattttctttccttcctctttttcaccttctgccaggcctgttatctgaatgctgttgctcattaccataatggccattaccaaactaatagctcgtttctttctgttgtaaatacgcatcgcggctctccctatcatttaagtctgattacagaatacatggtttccaatcacgcactgtatatgtccattttccttttccagggaaaaatacatggtcttaaaaggcagaatctgtgtttccccatccaacactgcttttacattccgtctcacacgctccgaaggtttcgcagcgtccatattcctgttcttccatgtgacgaactgactgcacccattgtccttctggctgagcacctcataaaccgtatcaggaaactggtcggaatacatccggttcaggattacctccaccacagcctgctgtcccctgtccggttccgcgcctgcctccagcatggtgattctggcaatcatgtcctgctctatctcatcaagctgtatcccccatctgttttgtggacttcctttgtttccctcaggattctctcttttcttttgtaattctccctttgctatggagcaaattgtctccggaacacggatcccggtcaccatcttcccatattggccattcacatccgccccgtccagcccaaacaccgtcatggcatgaattgtgaatgacaaaatcactatgaaaaacagattgactcccacaaactttttcatcggacattcccccggtattctgtcttttgtatgtttcaccggcccgaagacctatattttcaccaccagagaattaaaaccgccgtaacgccggtaaaagaaatcctttgctttactcttgacaaccctcactcccatggcatccatatcaaaaccgccttcctggctgacacggcctgtctccagggcaaaggggtcaaaatattttgcagtgtcccggatatggaggacaaattccccctgctgcccggccaccagtgtaatctcgatgcatacgtcatccccgcctccgtcccgcagaattacaacacataattcttcgatggtcatggtcacgtaatacgtctgtctgggactggcctcccatttttcacaaaatgccccggcctcccctgtgaccagggtcatatcctggtttccccggttgaccgtgcaggtgtaaaccctggatccgtcaaattcctcgttcctgccccggcccgctaaaaaccgtattatccacaatcccagtgaaagtacctcaacagccgggaacatccaccagaacaggtccattctcaggaaagagaagaacaatacgccgggtatcagcacgatggcgccccgcagcgacgaaatgataaggctctcccactcctgattgcaggactggaaatatccggccaaaagaatggatataccggcaaacaccgtaccggcgcagtaaagcctgagggctcctgcccccatggcggcagccgctgcctcacgcagcccaaacagggcgcatatgaatcggggaaacaggaaaatcaaaagagctgccaggcctcccgcgctgcatccataccgaaaggcgtatctgcgcacattcctcattccctccccgcggtgttctccgcaataggtgctcaccatgggctgcatagccctggtggtcccctcgtaaagatagagaatcagataggaggcattctgcagcatgtcaaaaacagctacagacgcctcattcccggcacggattaggatgttattgcacagcagcaggaaaataagctggtacagatactggacggaactggaacatccgtctttaaaggccccggctgcagcccccggcgcaggacggacaggccggaattttagtatatgccttcctcccaggatacctggcagatagcacaggatggcaactgcctggccaatcatggtggacagggctgctcccgctgtgccgtatcccagtatcagcacaaacaggatattgaagccgatatcagtaaggttgcctgcaaccgaaccaagaccggctatcttctcattgtcatcattacgcagatagtaattgagaatattagacatataaaaaagaggtgtggctgagaccagcaccaccaggtagcttctggtggcttcaaaaagcggtccgtcatccggcacagtgcccaggacagccagaagcggcgtcatgaaaacatttcccagtattcctgtgaggatgctaaaggccaaagcccctgtcaccacctggttaaagctgtccactgcctccccgggctttccctcccccaaaagcctggagtacctgacagaacctcccagccccagcccataggcaaacatacagttaatcatgtaaaccggaagaatcagcgcgatggcagccagacccacggctcccattctctggcccaccacaaccgcgtccgcaatatcactgagcgcccatcctgcggaggaaatgatggcgggtccccacatgcgccggaatatcctgcctgtaaagcggtccctgtttttcatttccctttttccactcccttttctctcattcaatggtcaggatatccgtaaatcctgtgacctcaaatacttccatgattgtcccgcacacattgcgtaccgtcatggttccctgcctgttcatctgcttctgggccgccagaatcacccgcaggccggcggaagacaggtatgccaggccttccatatcaagcaccagtctgtccacaccctctaatccgtttttaatcacagtctccagctccggtgctgttgtggtgtccagacgtccctccagctccagagtcaggcagccgttattttttgtggttgtgattgtcattatcatttcctccctgtcattcttcatttttcataaaaccgaatctggtatccactctgttttccatacagcggcaaatgctgctgcgtatatggagctttgtggatttacggaagtcggcatacctgcagtaccagcactcccgcacagcaggcatgctccggctggtcccggtaaaatacggacagctgtaatcctctgtcacaatcgggtagccgtcatctgtcacgccaatcaccgctccccggatttccttttccgacatggccgcacactcctctttcataaacatgatttgcagccaaatgtgaaacagaatcatctgaccacggaacaaacatatcacagcctttaaaaggaatgagggatgcaggataaaaaacggtttttccgggataattgacaccggactgcataaccctgactttaacatggtgtggcttccttctattccagggccagtaccaccttgaccgtgaattcatcatcggtgtggctgaccgcacagtagccgtggtagcgctccgccacatgccggatactgtccagtcccagtccgtgtccgttttcctcctttagggtaaccagccggtccccatcccattttacccttccgtcatagctgtttctgatttccataatcaggttatgccctaccaggcgggccagcagcgagatataccgtccggttccacggccctggcgttggcatgcctccacggcgttctgcatggcattgcccagcaccgtgcacaaatccacgggagtacagggcaggtcaggaggaatctgggcgtcgcaattgaacctgatccccccgtttctggcctgttccccgtaatattttaaaagaatattggccgcatggtccccgcagtaatacaccccgtccatgtccggcatctgttcaacaagggcatccaggtactccttcagacggtcatagtccccggcctgggcgtatccgctcatcacccgcagatggtgcaggatgtcatgctgcatcctgcgcacctcatctatatggcctgccaggaaggcataatactgctccaactgtctcttatctgcagacataataaatcttcctcctgtactaaatgcgggtcagctcagcccgttccagcagatatccgaaatacgcgtcccggattgcgcggctgccccgctgccgtataggaatatgggccccggacatcatcaggaaatcatcctccgccaccctcacccggttcatattcacaataaagctctggtggcaccgcaggaatccgtgtcccttcagctccttttccacatcgtccagttttgcgtatacccggtactcctctccgttttccagaaataccagaagcacattcctgcggctctctatgtattcaatctcccggtaggcaatcctgcggcccctgcatccctttttaagcagaagtgttttctggtttccctcgtattcctcctgcaaaaaacgcctgagcagggctgccgttttttccccgtccaagggtttgacaaggtatccgtaggcatacacatcatagctctccagggcatatgccggagtagtggtcaggaacacaatggacacatggggagcgtaccgccgcagacagcgggcagcctccattccaagcatgccgtccatgaaaatatccataaaaataagatcaaaatcaacggaaccgtcatcgtaatcatccaccatggtttcgccgcggctgtattctgccaatgtatactcgtagggtacggccgcaaaaaaggagcgcaggaaaccctttaccatatccctttctgatttcaggtcgtcacatattgcaatacgaagcatgatcatccatcctctttttgtatcttaacgatgtattttaccataatatggtctgtatacctgattatgggataaatgacggatttttttgtataaatggcatattatgtccctattccgtcactctctgcacaaaaccagacagattctaatgccgattttatcagaaagattccagttcatgtggaatcccggccactcttaaccaaaatgtaacctttttcccggaccgctcccggaatatatggtatactgttattgagtacagcttgaaaaacaggcatctgacgggaggaagggaccatgccgtatcttttgtttgtggacgatgattccaatgtgttaaatataaaccgtaattattttgaatccaggggcttttctgtatccgtggcccagacagcggaccaggccctggaccatgtgaaaaaatatccggtagactgcgtggtgctggatatcatgatgccgggctttgatgggttcctgctctgccgccgctttaaagcccagatgacagcaccagtcattttcctcaccagcctgacagaaaaggaatatttatatcagggcttttccctgggcggagatgattttctcaccaagccctgggaccttaaggaactggagatgcggatccggaccagaataagccagtgttccaaccattcccttaaggatgaacggctggaattcccgcctttaaccattgacgccggcacccgccaggcgtccatagggaatgtctgtgttccgctgaccgcctatgagttcgacatattactgctgctggcccgttctccgggccatgtcttttccccggactccatttaccgtgaaatctggaaactgcctgatttggacaacacccagaccgtcaaggtgcatgtggcccgtatgcggcataaaatggaagctgcctgcccgggacacagcttcatcggaaccgtgtggaagcaggggtaccgtttcctgccggaaaacagctgacagtaatcgtgagaggcggtgaacagccatgacgcagtacaggaattcaaaatggctcaatttaacggcagcggcagccctgcttctggctgtccttattctgttccagttcctgtatcagaaagataacaaatacacaaacgggcctccctatggaagtcagggcatctttgcattctccgcccgtgacctgacaggcagcaggcccctgtttctcattgacggatgggaattctatccggaccagctgctgacacccgataccatcggttctgctccggaccaatccatgtccttcatattcatcggacagtattccaacttttccttcctctcctccggccattcgccctttggcagggccacctaccgcctgctgctgcaatatgacggagaaccaaggcttctgaccctggaagtgccggagctgtttacggattatcaactttggataaacggacagccggtggaacagggcagcccctttgcagccttttacatggacggcaccgccgaaattttgttaaacacagacaaccgcagccactattacagcggtctgacctatccccctgcccttggcacccctgaggctgtccacaggatgttatttctgcgccatatgttctacggcatactgtgtatctttcccctggccctgtgcctttacgcggccgctgcctggagaatacgggacagggacaggcgcctgatacatttcggcttattatgcctgttcttttccatccactgcgcttatccgttcattcaccagctgggtctgtccggaaggctctggtatgccgtggaggatgtctcctggatggctatgctgtatgaggtcatggtgctctcctccgtggaagccggtttcagcggaaaactgtggtacaggagattcctccgcccggctgcggctgcggcctgtgccgtatgcggcctgtccgtcctcttcctcatacctgccgccccccgcctggtgaatctttacggcgccttcctggacggatacaagcttcttatctggctctatctgctggaatgtgcggtatacggcctgtggatgaaccgggacagcgcgggcctggtgctggccggatgtttaaccatgggggcggccatggtgtccaatcttctggacaataaccagttcgagcctgtttatacgggatggcagacagaatacagcggctttatcctggtcatcattttctggattctcacggtccggcacataagccgggtcctgaagcagaaccaggcactcaccgagcacctggaggaccaggtacagaagcacaccagggagcttcatgcggtgctggatgaacgcaaggcatttttctcggacctggcccacaacctgaaggcgcccgtggtggccattcacggatttacagatttgattctcaggggaaatttatatctggatgatgatttgaaggaatatctggataaaatcagcagtgaaaatgaagaactatgcagacgaatgtacgtgctgggagacttaaatgcttttgataagattacggagccaagggaattaatagaaataaacggcttgctgtcccaggtcagtcacgataatgaacctgaggcctgcatatccggtatagaactgcgggtggaaaaactggaagaccaggcatttatcctggcgcagaagagaaagctgctgctgctttttgagaacctgatttacaatgccatatcattcacgccggaggacggcgttatcaccatttccccctgcctggaccaggacggcgtgacgatacgggtaagcgatacaggtatggggattgagcctgagcatcttccccatatctttgaacgtttttattcaggacggcccgatgcctcagaaagcagcggattggggctctacattgcccgtatcacagtggaagaactgggcgggagcattcacgcggaatctgtgaaaggacagggaagcgtgttcacggtacggattcccctggcggggacagtcccttccctatgaaatgataggccgtatgtttttgctttatatttcccgcagaagctctcccagcctgcggatcccctcatcaatcatgctgcagtccgcgtttgtaaagttaaggcgcatggtgttggtatcagtcatattgatgtaaaacggatcaccgggaacaaacgcaacctttttctccagggctttgggaaacagcgataaggcgctgaccccttccggcagtgtcacccataagaacatgcctccgcggggacgggtgtacctgactgtctccggaaaataccggtccatcgcctctgtcatagcctgtgcctgctccttatacagctgcctgatttggtcgatatgggcgtcatagtcgttgtgcatcagataatcccatatcaggtattgggagaagatatttgtatgtaaatcactggcttcttttgccaccgaaatatgtttcagaagttccgtgtcagcgcaaatcataaagccggttcgcatgcccggggtcactgtctttgaaaatgtccccagcagaatgctgcccggcagctgtcctgccccgatataaggaatgcggccgccctcgtcaaagcgcagttccccataagggtcgtcctccaccaaaacgatttcccgctccctcagaacctcgcggatacacgctctgttttcagcacaatagctgagtcctgtggggttctggaagtccggaatggcatatataaatttgacatcatgtttcagagcatcttttaactgttctatatccatcccttcctctgtcagctcaaccggataaaataccggctgatattgggaaaatgcctgtatggccccaagataactgggcttctccacaatcactccgtcccctgtgtttaacaggaccttggatataaggtccagggcctgctgggaccctgtggtaatcaggatattttcaatgccaagtttcaggccgaatctgcggttgtagcggtccgctatatactggcgcagctccgggagtccggccgtgatggaatattggaacaggctgctcccataatcccttacaatgcgctccatggataccagaagttcctcctggggaaatgatacagggtttggcagtcctcctgcaaatgagatgatttgcgggtcagccgcggtttttagaatacttcggatgaatgacggtggtgtggatttaatacgctcagataataaatgttccatactgctgctcctttgtccattttctttacagtggtttttataatggtatcattataaacttgcaaaaggactcgaacaacagtaaaattgtatgcaagacaattttgcaaatacccatacaaacaaaccacagagatcatacagaggaaacagattatgtctatcaattcatttgacaattatcccatgagctggaaaccggatttaagcagaacatcaggcccaaaatatctggcgctggtaagcctgatggaagaagatattaagaacggaacgctgaaagcaggaacaaagctgccgccccagagagaattggcggattacctgaatgtaaacctaagcaccatatccagggcctttaaattgtgcggccagaagggccttctgtctgcctccgtaggaaacggtacctacgtctgtgcggatgtctctgcggagaccattctgctgtgcggacgggagaatccgcggatgattgaaatgggcgcactggtcccccaggtgtccgggaaccggctggtcaaaacctacacagagcggctgttaaagcgtcctgacgccctgaacctcttttcctacgatgacccggagggaacaggacggcagcgtgaagccggcgtggcatggcttcaaaaatcaggcttttctacccataaggaccatgttctgctggcagcaggcggccagaacgcactgacagcggcactgggcgcattgctggaacggggggataagctgggaacagaccccctgacttatccgggtgttaaaaccgcggccaagcttctgggaatccatctgatacccattcagaatcatgattatgagatgacagaggaagggatccggtatgccgtacaaaacgaaaagataaaaggcatctatgtaattccggattaccacaatcccacctcgcatatcatgtccctggagacaaggaaaatgattgcagcactggccagggagaaacatatcctggtaattgaggatggaatcaacaacctgctgacggaaaatcccctgcctcccattgcttcgtttgccccggaacaggtcatctatctgtcaagcctgtccaaaaccattgccgccgggttgagaactgcttttgtccatgtgccagaccagtatcaccgctgcctggccaccaccctttattccatgaatatttccatctccccgctgcttgcagccgtatccgcgggactgattgcagatgggactgcagatgaaattataaggggacggaaggaggaactgcgcaggcgcaatcatataatcagccaatccttaaaaggctttgcactggactgcccgcctaccagccccatgagatacctgcgcctgccggattattttaccggcaaaagctttgaaatctgcgcaaaacaggccggggtgcaggtctatggggctgaacggttttcagttggcaataaaccggcagaaaaggcagtccgcatttccgtcataaccccgccgtccatgggggatttggaggaagggattagacggttgagggggattctggggtgagccgtatcagtcttttcctagcgccatcatatactctgatctgagaacattggcctgtcaagcttgggattcactatggggtaatcctcccgatagtgagcccccctgctttcctgtcttctcaatgcggcctcccccataagacgtgaagctgtaatcagacaatacagccggaaggcttccatattaaccgcatcctgcctgggagactctgcaagctgccgtccaatccgctccacagtgccaagtacctgcataagaccggcttcatttctgctgattaaaagatgatgctggtttaccgactgcagttcatggattaaaccttgtgtgtccgcctttctgtgtagtatttcccacaatctgtcatccgggtacatggcagtactttctgtctgcggacggtggatacctgcccactttgctgcatttgtccccgctattttcccaaacacctggcaggtcaccatcatattcccgcccaggcggtccgctccatgaggaccgcctgccacttctccagccgcatacagtcccggcagcgatgtgctgccttctgcatcaatgcataccccgccgttaatagcatgggcaaatacattaatctccaccttctgcgttaacagatccacccccttgtccttcatatggttgcgagccaccggccacatgtgatggagtccgcagtcatccggtacatgacagatataatcatctttcatatgtcttaaatcagcaatgatacctccatggcgtcctcctctaccggctctgatttccttttgaattgctatttctaaatatttagaatcatcactggatgaaaacgggaagtgttttctatgttcatccatcacataatccggttgcatagaatctggtatgtacttttcaaggaaactctctccctccgaattagtcagtagaggatgggctgcccagatatatccgttaaaaatattcataagagggtgtgaaaatccgattccgctctgcatgaattccatattaaccaatctggcacctgattcgtatgccagcatatatccgtctccgctgacatcccccggattcaggttcttttcaaaagcctgggatgcgcctccggatgccagaatgactgctcctgcagagatatagattagcttcccccgcgaatccaccccccatgctccgcagcatattccattcttcttcgccagctctatgatagtaactcctgtcagggactgaatatctggacgtctgcgtatctgccggatcaatgcctgtacaattggttctccatggccccgtatgacatgtgtacggggaatgcttgcaaaacaacttttaaatgtataatatccgtccccttccctgtcaaattcgaccccccatgattcaagttcatcaattgtctcaggtgctccttcagccaggattgcagccagcttttcatccgccattccctgtccggcagccattatatcctggtaatgacattccacatctcccggcacatggggatcccctgcgttatatccggccatctctgccacaggatatgtagtggccccgcctaatccaagcggcattttagcagctatgattacatcagctcctgcgtcgcaggctgctaaggctgcccttaaggccgcccctcctcctcctataaccagtacatctgtcaccaatctgtccattttcagttcctctctgcctatatgattatctgaactgcggggaacgtttgccaaggaacgcatctaccccttctttacagtcctctgttttgaatatgctccggctaaattccaggtttttataaaaacatttatctgaggataccataccgatttcccgtacccccttctttatcagcttgatagcttcaaacggtttatgagcgattctttcagccaggtcaagggcagcactgactgtcttgccggccggagccagtcggttgaccagtccgagacgcagacagtcctctgcatcaatgaattctcctaaaaacatcatctccatggctttggaagcaccaactaatttaggcagtctgaaaattcctccgcttcccggaaaaacccccagattaatctctggctgtgcaattcttccgctttcggaaagaattctcaggtcgcaggccattgccatctcgtaaccgccgccgcatacatttccttccatggcagcgataaccggcttatccagaaattcaattgcattgaatacttcattctccttctgcagcttttttccaataacatcatcccaaacctgaggaaattcctttacatcagaacctacgcaaaaggctttttctccagagccagtaagcaccaccacccgtacttcatcatcctgttccaatcggaacagcgtttcctttaactcgcggctaagttccagggtcaccaaattaagcggcggattatttaaagtaattagcgctaccttatctgctggtttctctactaaaatcaggttgttttcatactccatatcaattcttcctttcatgatttctaacaatcagtccctttctctctaactggtttaattcccgctgggtatacccggctttttctaatatctcgtctgtgtgctggccaaaagccgggggcagattacggactgccggacgtacgccgtcgtaataattggcatgtcctaatccccgcagaatcctgccctcactttcccccagctctataaacggccgattataaagaacctgatcatccttcattacctgctcatactcatttaccggagcaaaccacatatcctccatgcgttcaaatatctccacccactgcgctgttgtctttttctgcatttcctgatttatcatctggtcaaattccacgcgtctctccatggcatcctgttccgtaaagttctctataacaccaggagtaaataagctgcacagccggtcatgatgtgtcaaggatactgttatgcatccgtccgccgtaggatataccccatatggggactgatgtatcctggtggacaagccggtatctgcccggtcaataaatctccctccatttaaataataaccaattgtttcaatctgcaaatccagagaagcagacagcagactggtctcaaccttatgcccttgtcctgttatgttcctgtggcgggctgctgcaataattcccaaagctataagtactgccgcatgctgttcaataagggctgcccctgccggaacaggcggttttgaacctggaccgttcaaagaggccagtccgcttttcgcctccatcagcagttcatcatccggactctggcagcatccgctgccatccgccgtacagatgcaccatataagctgtttgtgagacctgagcaattcatcatattggatgccccacccctccagcagtccaggaggagaattatccagtacaatatcatagtcctgcagcaggcggtgtaatatatcaatgccttccggtgactgcggattgaaggaaatactcttctgattccggcctgtcatctgaaaaacagaccgttttccccatccagaacacttccaggccggatacggcctgtcatatcccattccacccgcacaacctcggctcccagatcagccagtatctgactggctgaaccgccataaagcccatggacaaagctgagtatcttcataccctccaacatcatagaatcctcccgattaagtctgcttcatcacagcagcagcgtacttaatgcagggacaaatacaatcaggaaaaacaccgctgtatatcccagaaaaaagggaagctcacctttggctatatcacccatttttaattttgagacagaggctgccgcaaacagatttactgccacaggaggagtcatacatccaataacattcgctatacacataatcattccaaaatgaatgacgccaattcccagggtctgtgctatgggccagagaaccggtaccagaagcacacaggtagctatcccctccaggaatgtgccgaacacaagcaataccagggcaacaatcagacagaacatccatggagccagattcatggccacaattgcatccaccagctgtcctgatattcccgagaatgtaaacagccatgaaaatgctgtggaggttgcaatgatgaacaatatcatggcactgctctttcctgaagccagaagtatacggtaaatatcccggggatgcagttcccggtaaacaaaaacacttacaataaaagaatagataactgcaacggccgctgactcagtgggcgtcataagcccggaatatatacctcccaaaataacaaacggaagaaaaagggcaggcagtgcatggataaaatgttttgcaagctggataatgcttgtcctctccgtatttttaggccacttctccttattggaatagtagatgcagattaccaccagtacaatggaaatcataagtcctgctacaattccccccttaaacatatcccctaccgaactgttggtaatggtacagtaaaccaccataatgatggaaggaggaataatgggacccagccccccggacactgtcagtaatcctgcacaccgttcttttggataacccagacgcaccatatcaggataaagcattccgccgattgccagtaccgtggccggcgccgaacctgacagagcggcaaaaaatgcgcaggccagtaccattgcgtaccccattccccctcgtatattgcctataatactgttgcagaaatctaccagacggcgggatattccaccttctgtcataagatttcccgccagcacaaaaaggggaatcgccataatggatactgaatccagggcagtaaacatccgctgaggcaccacagccataggaacgtcaaagcacagcagagatgccatggtcgccgctcccaaagaaaccgaaataggcacaccgattatcagtaacacaatcatggttccgaacaaaactattgcagtcatgacacatcctcctttccttggtcttccgccgctttttccataaccaggcaaaccagcgctgctgcctgtattaccgtaatgattccaaagctgagggtcaatgcaaagtaaggtatggccatgggcagatgcaaaccaggtgatacctgcccggaagacagctgcgttttaagaatggtaaaggatgaaaaaaagcagactccggaaaaaattgccaccactgcctttgaaataatccgcactacccttcctgtcattccgtgtattttatccgtaatagccgtgatggaaatttgtgtattgtcccttaatcctgcctctgttgccagcagtgccatataaaccatacaatagcgtgctaattcctccagccatgaaacacctgcatggattatatttcggttaactacctgagcaaaggatgccagtaccataaccgtaaatgtggccaccagaataaaatcctctatcttctgtaaattggcaaacagccttttcatccttatccctcctatttttcagcttcaatcgcttccacccaggccggatccattcggtctgaaaactgttccattgccggttctaccaactttcgcatatcatcaataggtatctcataaaattccacgcccagctctgtcagttcctttactgccgcctcatttgcctccaccagataatccctctgtctctgtgctcctgcttttacaccttccacaaagtcttccctcaagtcatccggtatctgattccatgccttgtccgacataaacacgcccatataaccaaaaacatgattggtccatgttacgtttttggttatctcatagtagcgattggcaatcagattggcgatagcgttctctgccgcgtcaatggtgccctgctgtaaaccggtaaaaacatctccggatgccattggtgtggcaattgcccccatggcattaaacgccgcaatatgtaaatcattctccatggtgcgtattttaagatttttcatatcttccagggatgtgaccggacgggtggagaagatattgcggaaacctacatccatccaacccactgtatgtattttctgctcttctgttttttcagcaatcagtgttccgactgttccatcaataacacgatgggcttcatctgctgtctcaaatagaaatggctggtcaagcaccgccatttcaggaatgaaagaggtgagtactgcgttggaggccgtaaacatgtcaatggtacccatttgcgcaccctcgtacatgtctctttcattacccagctgcccgcctgcaaatacctgtatggttattcttccgccggtagccttattcacttcttccgcaatggccagtgctcccttatggaaattgcttccatccgggtccaccattcccagtttaaacgtaatggcgtctttctcaggctttgcctccgggaccgaatctgcttctgttttcacatctgaaactcctgctgaagtggtttccgcattcttaccctgcccgcaggctgccagcattccggctgttaatactgttgtcaacaatactgcaatcttcttcataatcaaattctccttctgctttatcctgttttatttgtcctgctttttttcgggtgacacagcctttccctgcttcatcatctcctgaatctgtgaatctgaatatcctgcctcctttagcagctctatcgtgttctcaccaagctccggcggcagccgtcttaaaggtactggttgcccatcatagcggttggcatgtccgagaactttcacctcgcctgctaccggatgattcatggtcataaaacactggttataaacaacctgctcatcctttacaacgtcctcatattcattaaccggcgcataccatattcctaactcctcaaatattaactcccactcatttgtagttctctttaacaattcccggcataccaccttgtcaaattcaatgcggttatccatctgatcctttgccgaaaaaccttccagcgcgcctggtgtaaatgcctgttccaaattctcaaaggaggtaagggagagtgtaatgtatttatctgctgtcttatagattccatagggtgactgatgaatcctggtcgataaaccggtatctgctctcggtgtaagcgtcccaccattcagataatatccaataggttcaatctgaagatccagcgctgaccccagcaggcttgcctcaatgcggtgtcccttcccggtcttatcacggtcatacacggcagcggtaatgcccagggctgccaatatagccccgtgctgatccaccagcgctgtccctgtaggcatgggaggatgatctcccggtcctgccaatgccgccagtccgctcattccctgtatgagaagatcctgccccggctttctcaccttgggtccactggaaccataacccgtacaggagcaatagatgactccagggtttaattttttcaattcttcatatcccaaacccagtttatccataactccaggccggaagttttccaaaatcacatcataccccttatcacggaccagcctgtagatggtctcccgtccctcgtcagactttaaatccaaagcaacccctctttgattgcggttcgccatgaggtagaaaacgctgaccccatttttgtacatattgcaaccggaccagcccctctcataagcacccctgcaagactctacctttaccacatcggctcccaaatccgccaatgcctgtgctgctgacggcccctgcagataatgggtaaaactaagaacctttactccttctaacattctgaacattcccctccttttaatatttttacagattataaacgtttataatttctttcttaaaaaaatccgaagaataaacactatacttcgaatcaaacatttaaaattataaacgtttataattttatgtttttaaaataacacacatagattgtgttgtcaatagttctttgtcagattttttatttttataatatttggttatctgtttttgtctaagtttcacaaacaggtatcccctcttatatcgcatactgactgccgaacaacaagctctcctcttagacgggcgggaggagcagggctgttgccagctatacattcaaggagataatccacacctcccttagccatcacatcctccggctgacgaaaactggtgagaggcggcatcataagtgaggccattgaaatatcatcatagccggtaaccgaaaaatctccggggatcgaaagtccgcaatcactagccgcactatatgcgccaaaacacagcatatcattggctgctattaaagcagtaggtctttccctgccttcaagcaccttccgtatcctcatataggaatcctgtatgtcctttatatcaaaaataaactgcttggcgcattgttccaacccatgttctctcaatgcctccatggtaccctcaaacctctcctgataaatctgattctcaaagcccaggtaagctgcgcagatatttctatggccctttccgattacatatttcgtcactgtatatgctccataaaaattatcactgggaatacaatttgcaattcctttaaagcttctattcaggaatacatacggaatgccggcattatcaaacccacgaaaatgctctatatgccttgaacagggcaatataatcacaccatccacattccgctttttaagggtatcaaccagacgcttctccttatttaaatcttcattggaattacagagcaaaatcatatatccctttttttctgcatattcctcaatgctcttagctacctttggataatatgggttggtaatatccggtacaattaaccccaatgtgtctgtacttcctatcttaaggcttctggccgaataatttggcttataatccagctccctgaccgcggacaataccttttccatggtcttcggtgtgatattttctttgtttgcaagggcacgggacaccgtacagatagataccccagccagttttgcaacatccttaatcgttgccatcttccatcccccaaattgtaaacgtttataattaaacactaccatttgtttcttaaactgtcaagaatttccctgctgtgggggggatattttatattgaactattttattgttcaaaaaggccgtccagaaattgccaaaatctcaaaccggcattttcaggacagcctgttataaaattatatgtatcacgcctctacacggccccaaacttctcctgagcatccagcacatactgcacatagaaggcagctccattcaccagggcatcctcatccagatcaaagcgttcattatgaagggaatagcagcaatcctttgactcgttgcggcatcctacaaaagcgtaaacccccggaaatttttccagaaaataggaaaaatcctcaccgcccggcgtgcctgcatattttaccagtcccttgtcgcccaggattttcctgacggactccgccgcaatcccgctgcagtactcgtcattgatcgttgccgggatatcagaataatagtcaaactcatattcagccctgtaagcttcgcaggtgctctttatgatacgctcaatcatacccggcagttccttctggagcttgggattgaaggtgcgcaccgtaccgctgagctcagccgtctcggcaaaaacattggccatggtaccggaatggaaggtacagatgctgaccaccaccgtatccatggggctggtctcccggctggcaatactctgaagggcatccactacctttgccccaacataaatgggatccaccgcgtactggggcatggcgccgtgtccgcttttcccgataatcttaatattcatgaaggaagccgatgtatagcggggaccgggatccacggagatggtgccgctctccaggtacgggaatatgtgcatgcccgccaccgtatccagcttccccacctttccggactccagcacctttaccgcgccgttggtcagttcctctgccggctggaagataagttttaccgtgcatttaagctcatcctgatgttctgccagaaccctagccgctgtcagaagcatgctgatatgtgcgtcatgtccgcaggcgtgcatgacgccctggttctgggaactgtagggaagattcttaacctcccggatgggaagcgcgtcgatatcgcagcgcaggccaatcaccggctggtcctcttttcctttcagggtggcaatagtgccggttcccgccacctcctcataaggaatccccatcccggcaagttcatcccggatccgtcctgctgtctctacctccttccagctcagctccggatgcttatggaattcccgccgcatactgacggcataatcatgatatttcccaacttcttctattacgttcacagtcaaaatcctttcttactaaatttcttcttacaggattgccctttttatatacctttttatatacctttttatatcccctcttatatacccttttacatgccttatttatacctttttattttacctgcttcacaggtacgccggttaaaacggaccataaccaatctgaacagccacaaacaaaaagattaactgcagaatcaggaaaagtccatgtaaaggcaggataaacttataccagctctttaacggtaccttgccaagcgacaggtagataagcagagtcccattggtaaaccagaaggtattggatataccgtcgccaaactggaacgccagtacggctgtctgccttgtaatatgcagcatatcagccaatggaaccataattggcatgaccgcggtggcctgtcctgagcctgatggaatcagggcattgacaaagaaatttacaatgaacatgcccaccgtgctcacataagcggaggcgctgcgcatcagattggaaagcccgtgtaccagagggtccaccagaccgccgtttgtcatggtccactggaccgctctggccacaccaatgatcagggcgccgctgaaggctcctcttgcgccgtcaagtaccatattaatgccatcatccagattcacccggttgattgcagcagacacaataccgccgatcatgaaggtggctgccatttccgtatatgaccagctcagattcaggataccgtaaatcgttacaaggatggagatggtcagggaaataactgaaacctttttgggaaggtcaaacttaaggcccggatcaaccggaatgcgcagggaggacgtgtccacatccttcacaaggctcttggacggatctgccttcaccttttttgcataccgcataacccataccaagctaagtatccacacgcagaccagtgccgcaatcctcagctcccatccggagaacatgggcagctcggcaatggtatgggaaattcctactgtgtacacattaaaaggcgcaaccgcaaagctgatcagacaggcaaatccggatatggccattccgaccagtgagtcatacccaagggagagggccagggatacgataatgggtacaaagggaatgatgtgctcactccatcccaggatacctccgaaaatgaaaaacacaatcattacaattgctatgattacctggctgctcatcctctcggaagcctttaaaacactgttgattgcagcgcctaccgtattggtccttttgtaaatctccacaataccgccaatcagcatgacacagaacatcatattggccgaggctgtcaggccttccggaatggaccggaatatgttaaaaaacgatacgggcgtgcgctccgtggcatgatagctgtctgccaggacccgtgtgaccccatccacggtttcacggtcataggctcccggtatcacaaaataggatacgattgcgcaggcaagtaccatcagtacaagcggcacaaacggattcaaaggcttgtttgctttttgcttatctttcgtcattgttttcccctttccctggcaggaatttaaaaatagcgtatgatattctccaccagttccaacattttctttacgtcctcaattacaacatactctcttgcactgtgtgaatgatagatattaaagccaatgggcacggtcctgattcccagctggtttgtgcaggtggcatccaggactccaaatgacctggccggtatcatggaaagcccggacctgctgtagatggaagccaatcgttccagcatatctgtattttcactgaaatctgtttccggaacatcctcctcttccctgatattgcatttgcaccccatgcgctcagccgtctcctccgccttacggcggatcctatcccgaatctcctgcttgatatcattgccaaagcagcggatttccacatcaaaccgggcgtatttgggcactgcattggacggcgagagggataccagatcaaatacattgatgctcaggttatcgttcagtctgcccacaggtatctgatgaatgatttccactgctgtcagcagagcgttgacccccggctcctcattgcggataacatgggcggcgcgcccaatcagttccacattcatataaagcctggcaggtgtgcgtgtcaatacctcccctgtcacgtagtggtcgatgacaattgcctcctcgctctctatcctggaatagtccgcatattttgctccgtggagccccagctcctggcacacggtaaacaaaagctctatggggcggtttatttctccctcctgcataagccgctccacagcctgcatgaccaccgcgatggccagcttgccgtcagcccccagtacgctgctgcctttactcctgatgcacccgccttccacacagacctccacttgattgctgggcgcagccgtatccagatggaatacgaacagaaaaggctttttaccggacctgcccggaattctggccaggatattccagccgtctgtcaccacctcattgcccagctcctggcgctcaaacggaatccccattccggcaagctcctgctccatatattcacaaaatgccttttcattatgggattcgcttgcgcactccgcataacgtataaaccgcgaaactgtgctgtctacgtttctccctccttccatttcttaccctgcgggcagtatttcccccacaggctgcattttcccgcaggctgcattttccccacaggctgcattttccccacaggctgcttgttacaagtgataccattttatcatttaggtatgtgaaaaactattgtttaaaccatgtaagttttattctgttttttgtttaaatgcacaaactttaacgtatatattgcgtattttccaggatttattataataaatgaaaaagagggcaataaataacggccccggacggcctgtaaggaggtttcctgtgattgataataagattatgtatgaaattatagaaaaactgcacgaaagcttttctgcttccatcagtatctgcgatgtaagcgggcgcgtcattgtgtccacagattcttcctgcatgggcgagatgaatctgcttgccatagaggcccttaatataaattccaaggtaaccgtgtccatggacagcaagattcaaaaggcaggcgcggccatgcctctgcgttttcagaaaagccggatgggcgccgtggttctccagggcgcaggttcctccagctcccagctggctgaactgctgagcaagaccattgaactattgtatgaggagcttatcctttccaagaaaaaacaaaaccggacccaggagcgggaccagtttctctatgaatggctgcacctgcagtccgattatacggaaaattttataaagcgcggagagcatctgggtattgatatcacaggaacccacaccttaatcctgatggagcgcaaacaggacgacctctttacgtccacctccatcattcagaatcttttagacgaccgtgatatcctgcttcccctctcccaggaccagaacctgattatcctgaaggagaacgagcatttcgaaaaaaaatataaccgtgtaattgccgccggacataactgccatacaggcatctgttccggcagcgcccaccttcacacagcctaccaggctgccctggaaagcctaaagctgggcaaaatactgtttccggacgagcatctccactgctttgagaagatgaagctggcaattgcgctgtctaaaacccccattcccggactggaggactccttttcccttcttgtcgcaaagggcagaaacgcccagctggccgatacggccataacctatatacggctgaacggcgatattcagaaaatctgcgacaaactccatatccaccgcaacagcatcccctaccgcatccgccgcatccaggaaatctgcgggcgaaacctgatggattactatgacatgctctgtctttatgcctcgttcatacggtatgcaggaaaggaagcggatatacagtagcgggaagggcaaaggcaggtactgggcaggcactatggcaagtgctatggcagctcctccagcatatctttaacgcattcaataaattttttcatggcaggagacgcctccttccatgacggaactccgattccaagagagacaaactggggagggtcaaagggcagggtgaccacatctccggaccagctgagggtaatgagcctgttgttcaggctcatgcccagcccggcctccaccatgcagtaggtggtatatgcatctgctgtagaaaagcgtatgtccggcgtcagatgtctggacccaagaaggcggtctatttccgtatcctggtttggcatggttatgataaacggttcgttttccagggcgcacaacggaaaggaagcctcccctgccccggggtgattcttcggaagccaggccagcagctcgtcctggcgaatgggaatccagtcgcagattgtcccggcggcaggctcagcaaaaaagcagcagtcaacggacatctcgttcagccaccgtgtcatctcgcggtttccgccctctttcatgttaatcctgacattgggatacagctgccggaaccgcttcaatatgggcggcagccacatggctgaaacactgtaatagctgccaatggtcagggcgccgcttaaaatgccgcggatatccgcccctatctccagggcatggttatgagcacggacaatctctcggaaagccggaatcatcgccttaccgttttccgtgggagacactcctttttttgtccttataaaaagcgggaacccaacctcctcctccagggcgttaatcatccgtgtgattccggactgtgtatatcccaggaaaacaccggctgcagtcaggcttccatggtcaatggccgccagaaaggcttcgcatttcgtaacatccatatctttctccatccatgattatttgtcatggttaatatgataaatcaggttttgtgtcatatatgaaatcattgtacaatagtgccaatgacatgtcaaacacaataaaacatattacgttcggtgtgggaaaggatggctctttgagagggttctctcccggaaagtgccattatcttcacacaccggagataagaaaagaggataacgaaatggaactttgtatgcacagcaggccttcttttgcttccgattatatggaaggcgcccatccggctattctggcccgccttatggagacaaacatgcttaagacccagggatatggaagcgaccccttttcccaatcagcccgtgaaaaaatccgcgcagcctgcggctgtccggatgccgaaatacattttctcgtaggaggcacccagaccaacgccactgtcatacgcggactcctgcactcctatgaaggtgtaattgcagccgggtccggacacatcagcgtccacgaggccggcgcaattgagctgggaggacataaggtgctgacactgccccatgtgtcaggaaaactcagggcagcggatatcgaaggtctgattgcggattacagaaaagacgcaaacagcggacatatggtcatgcccggcatggtttacatttcacatccaacagaatacggtacgctgtattcgctcagtgaactccaggagatcagcagcgtgtgccgcaaaaacggtcttccgctgttcctggacggtgcgcggctggcctatgctctctcctgctcctgtaatgagttatccctcaaggatatagccaggctgtgcgatgtgttctatatcggcggaactaaatgcggggccctgtttggagaagcggttgtgataacgcagcaaaacctgatcccccatttcttcaccgtcattaagcagaacggcgcccttctcgccaaaggcagaatgctgggcatacagtttgacaccctttttgaagatgacctttacatgaaaatcggcgcttccgctatagcggcggccgaccaaatcagggataccctgacaaaatgcggataccgcctgttcctcgattcacccacaaatcaggtattcattgtaatggaaaatgaagccgccgcccaactggcccggaaagcagagattaccttatgggagaaatatgatgactctcacaccatggtgcggttcgtaacagattgggcaacccagcaaagggatgtggacatgctggttgagatactggaacaggaatgtaatcccacgctggcctgtgtttcatagagggcgccgcaccacaggcaggtccaagttttctttgagaataaaaacgcgctcccagggcgggaatattcggaagattcccgccctcccctcctttccttttcattggagaatttcacattcttgtcatctgcccactatcaattcatatttcattctattgaccggctcatttaattgctccataataattctacagcattcctgaacatgttcccctctcagataccatgctgtttaattgcaaataccagaatcttgtcatataatatgggttagaaaccaaaaagtacttggtctttatgtctataatagagcttctatgggtttatcgcatccggaacagtcggtaaagatttctaacgtttgcgcacggtaggtcattcacaccgattacccggccaaatataaaacttttagtattattaggagagacgaggatgggcttgatatacgatggcttgatgtatgaaagaatatatgaaatattaaaggaccggattgaatcaggagtattgcccgctggtacaaaacttccatcgcgggatagtctgtgcagggaatttggaacatcgggcaaaaccattcgccgcgtattatccatgctgaaggaaaatggactgattgaaacacaccagagaaagcgtcctgttgtaagtttccgtcagcaaaccaggcgtccaatgatacatcttgcgttaaggagagtagatacctcaattaccgatgaggttctgaaaacaggagtcttactggggtatccgctgattgaaaacggaattgctctctgtaatcaggaagacttcaaaatcccccggaaaatcgtggaaaatatgaatatacatgactccgcagagttctggcgcctagccaaacagttccagagattttttatcagacgaaacgaaaacgatttaagcctgcgtgtaatggatagtctggggcttgcggagttaagacctctgcaagacagcttagaaatcaggaccaggttttatggacaaatgcaggagttgatgagggttattgaaaacagaggcgataccgatagtgtgcatttcgatgacctgtccggaatgtacgggctcacatatggaagtgaacctgccttcgatgtccctgtggactccgcagctgtacttggcagaaagcagctggaaaagctcttactgagagaagaagtaagatattcagctgtttatatggatcttttaggtcttatcgccatgggacgttaccagccgggagacaagctcccaactcataatgaattgcagaaactttataatgtgagtgtggatactactcttaaggcaatacagattctgcaggagtggggtgttgtaaaagcagtccgcagtaaaggtatcttcgtaatgatggatatacaggccctaaagaaaattgaaatatctccccacttaattgcatgtcatgtccgccgttatctggatactttggatttgctggccttgacgattgagggtgtttccgcctatgctgccgcacatatcgcacagaatgaaattgaggaggcgataagtgatattaaccgctgctggaatgaggaccacctgtatatgcttaccccctcattccttctgaatcttattgttaagcataccggggatggttcactcaatgctgtttatacacttttacggcaaaatctggggataggcagaagtattcctgccttgtgcaaaacagaaaaaacagctgaagactatgaactgtatgagcaatgtatcactgcactgaatcagctttacgcaggaaggcaggaagatttctcaaaccggaccgctaaagtatttcggtatatctacgattatgtaactgaaaaatgtaagaacttaggctactatgattctgccatggctgtctacgatggcagtgcgttgtggaaataacagccctcccgccccatttataaacaggaactgtccatggcggaagcagctcccttttcaggtgaagcagctgccgccatgaagaggtaacagaatgaataagatcattccccccgtctttcttatcttaccgcccgtgtcgctatcgtcaattccgtcaattaaataatccccgcaaaatattgcatttcagagactaaaaaaaccgcatgtattgttgatatttaaagaccgcggtgatataattgtttaatatatggttaaggtaccaagattgtcatgtcagcaaaaagtacccggtagtatagtattcttttccttaccttcgtctgaagcgtaaggtatatttttgtttacctaaaaactggttaccatggacccggctttcagattttttactgtaagtaacctcatgtatccgtttgagcgcgcagttgccgcttgtgaaacaaagtaaatcagcggactgacaatattcaattaaaatgattattaagaagaaatgatacgattgtaaaagggggatatcaatgcaatggataggatgaaccatggtactgtaaaacgccagctgaaatattgtgttggaataggggcttctgccggaggtgtggaggctttacaggagcttttccggaatatgccgctggatacaggtgcctctttcatcgttgtacagcacttgtctcctgattccgtgagtatgatggataaaattctgcagaaatcagttaaaatgccggtacggctggcagaagagaatatggagctccggcctaatgagatttatttaaacattcccggcatgatgctggaggtagagagcggacgcctgcatctcagtcctgtgcaggaccgcgtacagcgctatgcgcccatcaaccaaatgcttaattcccttgcttcggataaaaacatacacaccattgccgtgattctctctggcagcggatcggacggtaccattggtatcggctctgttaaggaaaacggcggtactattattgtgcagaaaccattggaggcacagtatgcttcgatgccccagagcgccatttccacgggcctggtggatctgacagaaactgtgtgtagaatcggactggccatacgggattatttaaaaaatcccaataaccaataccttcactatgatgacggggttgagaatcaggaactggcaggatattacaaccagattattgatgcgatatcaaagtattctgatattgatttttctgcctataagcccaatacaatttaccgccggattgaacgccggattgcgatccataaatttacctgtattgaggattacatggaccatttgctggcatccccggaggaaaaggggcttttgtgcagtgatcttctgattggagtgacttctttctttcgggatgaagccgccttcaaaagtttaggcgagcatgtgcttgccccgctgcttcggaaaaagaaatcagtccgtatatggagtattgcctgttccactggtgaggaagcgtattccattgcaattttactctgcgaatatatggaacggctgaattacaacgcggatgttaaaatttttgcctccgatacggacccggatgccattgccgtagctcaaagaggcttctataccgaaggcagcctggccagcattgatgaacacatgatagaaaaatattttgacaagaaagaggagggctacatcatcaaggacatgatccgtaagatgattgtttttgccaggcacaatatattcagggatgcccctttttccaaacttgatttaattgtctgcaggaatatgttcatctatgtaaaaccagaggtacaaaagcgtaccattggaaattttcaccatcttctgaatgacgatgggtgcctgttcctgggcagcagcgaatctctgggcgatttggaaggagcatttgatgtcctggacaggaaatggaaaatattccggaaaaataaaggggtccatacggaaaacaacggcttttatctatgggataacctttctcaccctcagaaggcagcacaagaatcagccggaagcctgcgctcaaaagtacggcccacaaatatctttgaacggcttttttttgattttgcaggaccgtccgtcctggtggacggttccgggaaaattgtgcagattattaaaagcggaggccggtatcttcggttacaggatggccagtttgataattccatcagttcgtgttttgcacccagcctgacgattcttctgaaccatattatggagcaaatgaaggaaagcaaacgttcctgtgttgaaaaaaatgtgacaggagtggcggactatccggatgaaagcctgaatattaaggtcaattattttaaccttgataatgatgaatattttctgattcagataggaatcggccgggcagccgtgtccggcccgtccgataaaagcctggatatcagtgaattaacaaacagcaggattgcccagcttgaatacgagctgggagaaagcaactggagactgtccctggccatggaggagtcagaatcccgtaacgaggagttacaggcaacaaatgaggaactgatggcatccaatgaagagctgcagagcaccaatgaagagatgcagtcaatcaatgaagagctgtacacaatcaatgcagagcaccagagcaaaatcacggaactgaccacggcatactctgattttgacaatctgctggtaaatgcggaggtaggtgcgctctatgtggaccgggatatgaaaatccgtaagattacccccatcatgctgcaaaacaccaatctcctgaactcagatttagggcgcccggtatatcatatcaatttcattgattcctataagagctttaattcggatatgaaagaggtggctgaaacagggacaattatagaacgggaagtgacggatgcccgcaattccatatggttagtccgcatccgtccttattatgaaaagccggagcaggtgggcggactgcttgtgactatgtttgacatcaccaggcgcctggaagcagcgaagtttgagttaaagcgcctgacggacagtgtgccgggcggtgtggtgcggatgcactatgacggagaactgatcattgattatgccaatgacagcttttatgccatggccggctgcagtccagaggaagtaaggtataaatttcacaaccgcctcagtaaaataatacttcctgaagactggacgcagatggaacagcagattgagtcggcggccgttggaaatggtattttaaaatgcgagtaccgtggacgcagagaagccctgcctgcgggttggtattccattcaggccacagtatttcaggtaaacggcctgacggaacttcagggcatcatcatggatatctccaaattgaaggactatgagcagcgtctgcaaagagaacgggattattataatacgctttatcagaacatgctctgcggaattgcgcagtatgcatacgacgaagatgctatggactttataggtatcaatccagaatcactccggatactgggttatccatccctggaagaatttaaacgccagggcgggcctacgatgctggacataacatatgagggggataaagaaagaattgtcggaatgctgcgctccctgaaaaaagagggtgactgcgtcggctttgaccaccgcatcgtccgcagggatggggaaatccgctgggtcaccggcgcctccaaactaatcacgtccccagagggaaagttgctgatacaaagtacttttattgatacaacggaagaaaaaaggacgcttgaacagcttaaggaggagagggaccgttatgatctgctgtacgaaacctcatacaatatggcagtgtgcggcgtcatccaggcagatgtcaaacataacaaaataattgctgtcaacaaagaggccctgcgtcttctcggaacagacgcggcaggcctagaaacgcggttgtttggccgggaagccgcaacgggtgttccggatttaagcagcatcggtgaaatgatgcaaaacgcagaggaaaatgagcacacacgcttttcccaggttcttaattttgatgacagatatatgtccattgaaggcgccgtggattacatcatggaagacaagagtttcagggtggtccagtttacgtttctggacaatacagagcgggaacttctgcgtcaggctgagacaaagctggagattgccacgaaatccagccaagccaaatcctattttctctccaaaatgagccacgaaatccgtacgcctctcaacggaattgtgggtatgattgacagtgcaatgctctaccgccatgataaagagaagctgcaggactgtttgaataagctgaaacgctcctctctccacctgcagcagctggtgaacgaagtactggatctgtccaaaattgaaagcggaaagatggaagttaatctgggaccagtgaacctgcagcagcttctgtccgatgtcatagaagaattcagtgcgctggccaaggaaaaaggaatcggccttacccagacgggaaaactgcatcatggatatgtgaataccgataaggtgaagctgcatgaaatactggcaaatctgattggaaacgcccttaaattcaccgacagttcaggggttgttctgctgaatatagaggaaacagaaattgccaaacaaaaatccctgtttacattccaggtccaggataatggtaagggaatcagccaagaagaccaggaacggatttttgaggcctttgaccagggttcccatgaccatctatatggaaactccgggagcggcctggggctgaccatctgcaagagcctgacagcgatgctgggaggcacattgcatgtggagagtaaggaaaatgcaggcgcggaattctcatttacgctcgcaatggatattttggacgaagaacaagagacggatactccggtgaaatccagctcctgttatcaggggtatcgtgttatggtagcggaggataatcttataaacggggaaatcgcagaaacctttctgcgcgcctttggatttgaagtggatttggtgcagaacggccaggaggcattccaaacatttgccgaatcaccggcaggaacctacaatatcattttaatggatatccaaatgcctgtcatgaacggatatgaagctgcccgtcagattcggtcctgtgaaaatgaggacgcaaaaacaatcccgattttggccatgagtgcaaatgcatttcaggaagacgtggcgcgttccatggatgccggtatgaatgaacatctgtccaaacccattgatatggagactttgttctgtgtcatcggaaggtttctgccattcccgaacttatagttaagcaccggcttacgttccatatcatgtgttaaaaaaatgcaggagccgccaaggaaaatttggcggtcatcctgcattttttatcgttaattcccgtattttgaaatctcctccatctgtatggaatcgtattctgctgccacctgggctgcactcttccctctgcagagctgctgacttaagtcccttacattttcccatacattgaaattcaggctgaaatcctgatttggaatctgtctgccttctgctatgcaggcaataagcgaatctgtctggggtatatcaggagcagttgcatttttagaagaggatatccttccctggtttttggcaaatgtgtcaagggtttctgcctgccccagcgcttccacaatggcaatggccgagtccagatgttttgacctcggattgattgccattctctgatccgctcccacaacgcagacagatccattttcaagcacaggcaaaggtgtcattgcaatctcaaacggatagccttctaatgctttgccgctatagattgcgcagataaaagcacagttaccattggcaaaaaatgacttttcttcctcttttttcggcagcgtttcaagtgctctatccggattcatataccccttatcaatcatcatctgaagaaagtcaaaccctttttccatatattcactgattgccgccgtaccatttgacaatgcttccagcttttcattacaatcgtcactctggtaaatatcatgaaggcctacacacataaccggaaccgtcagggcatagtccttgtttgccccatagggcagaatcccattctctttcagggtttcacatacattgagaaattcctccagattctccggcagctttagaccgtactgtttcagcatgtcaacattccatataaagccgaatccggtgtaagatagcggaatcgaaaatacctttccgttataagtgctctgtgtcagcgcatcgtgcgacagattcccggtgaactccagagcggacatatcatatatgtaacctttctcatcaaactccagcacatcttctgcatgaatcatatataaatcgtccgcatttcctgaagccagacgctttagaagaagctcccggtatgacagtccgtcttctgcataataattggcagaatcactgtaaaccgttatattcgtactttcgtcttgattcagaactgctttgcagcgctcttctatcgcagccgaaacctcagcattctctgtaaaaacagtaaccggagtttcccggatgccgtggtccacatacagctgcggatttgcctgctcccgattgcagccagtccccaaaagggcagctatcataagaatccccaacaatcccctctttttcctgatcttcctcattgtttctcccccaatgcctctttatttaataacttccggacagtactatataacttatccaactccacaggttttcccatatgcgcattcattcctgcgtcctggcacctgcgtatatcttccttaaatacatccgctgtcatggcaataatcggaactgagcaggcatccggccggcccgaattgcggatttctttcgttgcctccagcccattcatctccggcatatgcacgtccatcagtatgatctggtaatatccctgactgcttttaagataagcctctaaagcttctttgccattatgggcgcaatctaccgcagctccgctgctgttgaaaatctcatacatgatttccagatttaattcattatcatccgccaccagaatcctgacgccttccagattatccgattcccggatttgctgttcttcatcttcctggtatccgccctggatgtactgcttcagccgttccaaaatatcagctttaaaaataggttttgtcagaaaaccgttaattcctgcctgaatcgcttcctcttttacattttcccaatcatacgcggacaacagaagaatcggcatcccgctgcccagccgcgctctaatccttctggcagtttccaccccatccacatccggcatcttccagtcaacaatgacaacgcagtaatcgtcttccattgtatgggcctgccaggccttttccactgcctctatcccgctcgtaacccagtctgcgcggatacccgtctcctggaggattaagctgatgctttcacaggcgtcctgatcatcatccgcaatcagaacagaatagccggccagatccggcagttcccgcacctgctgttttggcagcttcaatgggatttccaccgtaaaacgggaacccatgtccttctcactttcaacatatatatcaccctccatcatttccactatgctctttgtaatagcaaggcccagcccggtaccggccgcctggctcattctgctgtcttccgcccgctcaaacggcgtgaatatgcgctccagaaattcagacgtcatgccgatgccattgtcctccaccacaaagcgcatccgtatggtatctgtgtccaccttagtctctgtaatcttcaggctgattatgccgccggcctgtgtatatttcattgcgtttgacagaagattgagcagaattttctgcagatgcagcccatcgctgataaccgtatcatgttccaaaatctgtgatttcagttgaaatatctgccccatcttatccatatccggtcttatgaatgaaatcagattcgcaatcatactgggcagatgcacattctcttccttaagcctgattttcccgctctctatcctggacatatccagcacttcattgatcagttccagaagatggccggatgccgctgtaatcttattcagacaggactctaccttttccatattgtccagactcttcagcgccacattggtcattcctatgataccattcattggagttctgatatcatgggacatggaagaaaaaaacgcggtccttgcccgattgctgttctgtgcctgcaggagggcgtctgccagatgctgacgcatgttatgttctttggttgtttcctgaaacacggcaagatactggccgtaatccgccggaatcatatggactgcaaaccagcgcttcacttcattgggatcatcccccaccatagcttccctggtcacctgttcctttaatgttccatccaggaaactgcatccggccggatcatccggcgccattccgctggcgctaaataccagctcaggcctttcctgtacctgctgtgcagtaattccaagaagcaccggcaggttgtcagacacaagctccaccttctgtgcagacggtgtatagagtaggaacacaaaatctatattggcggaaagatttcggaacagcttttccctgtactccttctgccttgcatcctccctcatggactgtcttccggttacaaggttagcaatcgcaaccgcaccaagcagaagaaaagcaaacatagtataaagcataatgataataggtgttgattcccgctgaaggactgcccgtggaatcatggtaatcagatagctcccctccggcgcgtctaacggaagaaagccgagaagggatttctggttttcattttttacaacaagggtaccacttattccttcccgaatcacctggcgaagcgtatcctgtacagccccgctgttcccctgcattgccagatagctgtaaatatccggctgctccgccgtgcctctggattctataatataatttccgccgctgtccaccacatatgcaaaaccctccccgttattaaaggtaaataaggttggaagattataatcatttataatccggtccgcgtagattgcccctatctgtttttcatcctttctgacaggagactggtatgtaatctgaagccgtccgctggcaccataataaggagccgacagcccgtcctttccggtagaaagcgccagctcctcaaagggcaagtccgatacatggacagaattcccatcactgtttattccttctccatccatgtttacataggtaaagtggaaaaaatccgttgattttgcatatccctgcaaagtctctccaactgcactctcctgctccgatgcaagcatattggccagggtgaacaaaagctccctgtccaggctgattttattatgcagtccctcgctgataaccttgctggaagtcagaagattctggtttgcgctgaggttcattctgccggtaatctgcacaagaaaaaatacagagattgataatgcagccacacagatcccggccggaaccgccagcattgcaattgatttttttttcggctttgtcttcatgtttatctcccttaaatatctgatgctgctttataagccaaaaagatatcgcaacactttgttaaacaatgtgtttgcgataattaacacgaagcagttcagagacagaggtattgtttataagatacatcgctttttcaatcttggtaccttgaccatatattcaaaataattatatcaccacaaactatatgaatcaatcattggattgtattttttccaagtatcctatcatactaaactgccgcttcttctgtttaccttataaaaatgtttgtctccgcaaatctgaccaatttaaaaatgcccataattcccttccaaaaggaacttcttcctttggaccggaattagtccagagctccatacttttatcagattcctgaaaaccaagtacctgttcccgtatatgttcctggtcatataccccaaaccagtctttcttttcatatccgttataggtggtggatatctcgatgaaaccgtcctgattgatcagactggcctgattgccgtagctgtcttcatattcctgcagcagctcttccagataatctatctgaattcccactcccacaacgccgattactgccccgtccggcgcagaaaccttgcagtttacaaagaccgtaatcctgttatccgccccttctacctggtcattatccacgttgagggaatactccaggtcattgcccagaagttcatagtaccattcattttccgggtcccctttttccattacgcggtcaaggccattaaaattatagtagcggcccgagcctgcagatatcagaaacacagaatcaaaaccatatttcctctggtatgtctccagatacgtttttgtagtctccgcaaaatccggggcatccatacggctttcctctgcaagaagatggtccaccagaaggctgtcatgagccattgtcagcgaaatgtttaccggctttgtaagcattgccgacagctgataataaattccctccgctgtcagggaggatacttgttctatgttctccagcgatgcccggtaattggcgcggtagctgaaaaatgccgtaagaataaatcctaccaccagtatgctgctgactaacaggttcgtctgaaacaacttattgtttttcattcgatacctccttataccacccataacaaccctgtttccagaatcttttatatctctttagtaacaaatcacaaataatattaattatttttcctatgttgaaataaaatgcataatttgatacaattgaactgttaacagcgttacaaaatggttgcatcgttagcacaatgaatccggaaaggcagcaacagctgttgtaggcaccccatatgaagcgattttttagaggcggactgatttccctgtttattttactctttctgttcggcagtattacgattcagacagtactccagacccagaccaacggaaggctcatcaactatgtaggtattgtccgcggtgccagccagcggctcataaagttagaactttccggccagcccggcgacgatatgattgcctatctggacagcattcttctggaattacagggcggagaggccacatatggtcttccttcacctgatgatccggcctatcagagggatctggcaaagctggagctgatgtggggtcaggttaaggacgaaatctctgcctaccgcagcggatccgctgacagttccaggctgctttccctcagtgaagacttttttgaacaggccaatcataccgtgttttccgccgatgcctactcagcccggcagatgcgttttcttctgaccggctgtctggtcatgatgggagtcatgtcactcacctggatctttatattgtgggctaactctaaaaatctattgaagcttgaagtccagaatgaacagctgaatgatctggcatcccgcgacactctgaccggtgtttacctgatcagcgctttcaaggaaaaagcccagcagattctggacaccaggccggaaaagtttgctgttgtctatacggatttctctgactttaagtatattaatgatgtgttcggctatgattacggtgaccttctgctgtcccaatacgggaaaatcctgcaaaaggggctgcatgaatatgaattatgcggccgtgtatcagcagataactttgtactgcttcttcattacagcgaaaaaagcgagattgcggcccgccaggctgccgcggattatgaaattctccgcttcatgcatacggcccatgacggccagatgctgcccacaaactgcggtatctgctgcatagaagatgtcatagagtcactgacaattgacggtcttctggaccgggccaattttgccagaaaaacagttaaaacaggaagcaagcagaattatgtttattatgatgagagtatccgcagccaccttagagaagaaaaagacatagaaaacaggatgctgactgcccttgaaaacagagagttcacggtctattaccagccaaaggtgaaccttgcaacaggaaaaatcggctgtgcagaggccctggtccgctggcagtcccaggccggcgccattattcctccggaccgcttcattcctgtattcgagagaaaatatatgattgaccgccttgaccagtatgtatatgaggaggtctgccgttggctccggagtctgcttgactcgggcagaaccccccttcccgtgtcggtcaatgtatcccggcttcaattctatgatcagaactttgttgaccgttatgtgagtatacgcgaccagtatgccataccgcccgagcttcttgaagtggaatttacggaatccattgcatttgacaacactgccctgctgctgcagaccgtggcccgccttaaaaaagcaggcttctcctgctcaattgatgattttggaaaaggttattcttctctggggctgctgaaaaatctgcctattgatgtgctgaaaattgacagcctgttcttcgatgaaggaccggaccggaacaaggatatggcactggtagagggtattattgatatggtgaaaaaatttgacatccgcacggtggcagaaggaatcgagtccatggaccaggtcgaatacctgaagcagattggctgcgactatgtacagggctatgttttctaccgccccatgccccagtcggactatgaagcgctgcttattcaggaatgctagcacataagcatatttttatatatgcgtgaccatcatggaacagagaggacaggctgacggtttgggaaaaccatcagactgtcctctctgcgtattacagtgcccggggccctgtccggcttgtccctcccggcccggtgaaaagactgctccctgcatttccctttctgtactttcccggcggcatttgatacagcttcctgaacagcctgttaaaatgctccacattctcaaatcccacccggctgcttatatccgctatgctgatatttgtatttttcaaaaggatggcagctttctgaaagcgtatttcctgtacaatctgtgtaaaagatttgcctgtgtattcctttatgattttggaacaatagggctgggaaaaatgaaactgcgcagcggtttgttttaaggtgacactctggtagttgtcttcaatatagcttaagattctcaagctctcttctgtggctctgcgcataacagagggaagctgaatacgatcttcatagctttgaagtattttggcaaacagtatcatcagctgattattgagtatcttttcatagtaccggctttttcccaggtattccaggaacatggaaagtacgtattccttaagcacctggtcacccctggccggaataatcagatagggattatggactcctgagtatagggactggttaaaaaaggtggctatcatatttgtgtcccttaacatattaaaaaatatatcctcaaaggtactccgccttaccagtatgttcaccagcaggctgtcatcaaacacgctcacgctgtgtatggtatccggcgccaaaaggcaaaagtccccttcctccatctcaatcctgtctttccccacatcctggctgcagtgtccctttaccacataggccagctcgaaaaatatatggcggtgccggaaagggggtgtgaaacggttgtgcttgctaatcacaatatggttcttatcctccgcgtcaaaataggcttcatccttcatgtcagaaggcatccagcctcctgatacctccggcacgatcaaacggcgctgtatgacttcattaaaatccagactttgcaagaaatcctccagcatccatttatcctgcttcacattataatactgctgataaaaccgctcatcctcgttaaattccatcagctggttctccaattctccggtagtcatggtttttccctcccatctctgttatgattgtaacagacaggttataaaacatcaatttatttgattataaaactcaatcgttttttattgccttatcccttacaataacagcatcaaatacaaggaggggttattgaatgaaacaagattcaaccatgaggtacgtgaagcagcagatatggaaacagagaattggctatggggtttctgactttgcatgcaacctgatttggcagatgatttccctgtatcttttatatttttacacggatgtcatgtccctgagtgccaaatccatcgcctttatgtttgttgtcacgcgatttatagacggagggacggatttactgattggctattgcattgaccatacccatacacggtgggggaagtccaggccttattttctcttcggagccataccatttgcactgtttgccgtccttgccttcagtgtacccgacatttcccagtcaggcaagcttatctatgcttatgtgacttacatcggtctttcctttacctacaccgtggtgaacattcccatggcttccatcctgccaagcctgacaaccgatacccaggaacggacagccctgtccaccacacgcaagttctttgcatttctgggctccacagtggtcagctacacggccttaaagctggtggattccctgggcaaaggcagcgaagctctgggctttcgtatcgtaatgataatctttggtttcattggatgcctgctattcttctttacctttgccactgtaaaagagcgggtaaatacggccgccgagagcgtttccctaaaagaaagccttatatccctgggtaaaaacaagccctggcttatctttgccctcaacattattttcatgtggaccggcttttttctccagaccagtgcaattgtttactactatacagctgtcataggaagcaaggagctgtcagtcactattgccaccatcatgtccattgtgcccatggcagccaatttcctggtgcccgcactggccggacgcatgggaaaacgcaacctgtatgtgggcagtgctgccatacaactggccgggctggttgtcatcctctttgcaggtataaaccatggggctatactggccggagcagtggtaaccgctctgggatacggcatgaaggaaagcatctatttttccatgcaggcggacccggtggactacggtgaatggaagaccggcgtcaacacagctggttccctgtccgccatcaacggattcctgggaaaggtggcccaggcggcagccggtggtatcagcggcgcccttctggcatggggtgcttaccagggcggtgcttcagaacagagttccaatgcggtactggccatcaaagccatgtacctgtatattcccatgcttcttcttatatgctccatcgtcactatgatgttttacaatctggataaaatttatcctcaaattaaggctgtactggattcccgaaatgaataaggagatatggaaatggcacagattacaaatcatatagaaaactttaaaatgaatataaatgaggatttcgtaagaaaagcccaggaactggagccagatcttcactacaaaacagtccggcccgcgcagctcgtctcattccagccttcagatgccccagacaagcccgatggctgggacctcccggtccataacagggcagaccaggtctttgactggattccctgccgtatgaagcctgtggaagcactggataccatgcctctgtcaaagggcagttccgtgtgtctggatttcggcacccaccatgtgggttatatatccttcagcctgacgcctgcgggcagtccgcctgatgctccggcccatattcggattaagctgggggaaatgccctgtgaaatcatggaggacaccgcttcctaccagggctccatcagcagcagctggatccaggaggaataccttcatattgatgagcttcctgccagaatctctctgcccaggcggtatgctttccgctacatggaactgaaggtcatggacacctcccccaaataccaggtactgctaagtgatgtatcctgtgataccgttacttccggcgacatgtcccaggtagagcccttgaatgaaaatgtgccggaagacctgaaacgaatcgacgccatagcccttaagaccatggaggactgcatgcagtcagtttttgaggatggccccaaacgcgaccggcgcctatggattggagacttaaggctccaggctctgaccaattacgaaacatttaagaactatgatctggtaaagcggtgcctgtacctgtttgccggacttacccaaaacgaacatcacgtaggcgcctgcctgttcctgcggccggccccgatggtagatgacacttccctgtttgactatggcctgttctttatttcctgcctccatgactactatcaggccaccggagaccgggaaaccctgattcatctgtggcctgctgcttatcaccaggctgagcttgcgctaaaacgtctggatgaaagaggcgtggtaaaagacagcagtgactggtggtgcttcctggattggaatgacagtctgaacaaacaggccggcgcacagggcgtcctgatttacaccctgagacaggccctttatttagcccggcttatgtgcagtgagacatccggggcagaatccgtcaaacagttggagggctggatagaaaccgctgtccgcggagccctggaatatctgtgggataaggaactgcagttcttcataagcggacaggaccgccaggtgtcctgggcctctcagatatggctggtcctatcgggtgtgctggaccaggaatcaaaccgcagactgctggaacatcttataaaggaggacccgcctgtgggaatggttaccccctatatgtaccatcattttatagaagccctgatacaaaacgacatgaaggagaccgccctccgctacatccgcttttattggggacagatggcggacatgggagcggactgtttctgggaactctttaatcccagggacaggtatgcctccccctatggctccagaatcattaacagctattgccatgcatggagctgtacgccctcctattttatacggaaatatttcaactgaatcagggcgggtttcatcggcctgtaatccgtccctgcctgatttaaagcatcctccactggagaaactcctttaccgccatggacctgccgaaaagatagccctgaatataggttcactccgcatatggcagaaattcattgtttttgtaatataattgaattagaatgatataaaacaagacagaaacattaaaggattaccataaaaggagcgaatatggagattcaactgaagaaaaacagtacaacccctctgtacaaacagattcggaacacaatccgcagtcagatactctccggccagctctccgacggctttaagctgccctcggagcgccagctggtggaaaagctgggtgtccaccgcaatactgttaaaaaggcgtatgagatgctcattcatgagggattggtctatgcctccgtcaaggcacccaggggatattttgtgagaaacagcccctccgaggtaaaacccgacggcaaaccggatacaaggaaagcattctcttctctggacaagaactttaattaccattttctagggacgcaaaatacgttccagcgtctgtataattcctcatacctctccgatagcatttcctttgccggcgttctggtaaataaggaaacacttccattgccttatctgcatgagattatggatgaaatcacttccggtgacgacttagagccattctggttctgcgatccccagggaacggagcgtatgagagcatgcctggcatccctgctctttgggcggaagatttacgtacagccccagaatatccaaatcataaccgagacatacgaggccctgagcaatattgccttcatgtatctgaaagaaggtgattttgcgattgtggaggaaccggtcatgcctgccattgtcaacatcctcctgcatacaggagcccatgtgctctttgttcccgtggaaaaagacggtatccagatcgaaatactggaaaacctggttgaacgctatcgccccaagttaatctattccatgccaaacttccacaacccctctgcagccgtaatgagcctggaaaaaaggaaacggcttcttcagtgcgccctatcacacaacatccccatagtggaagacgactccttgttcgactttaactacagcggcattacgcttccaagcctgtactccatggatcgcaccaactcggtcatttatatagattcctttaatctgtcctttttccccggcgcccgggtgggctatatcgtggctcctgataatgtgatcaagacctatcggcgtattgtgaataaggatcagatgtttctcaacagcttaagccagtatatgtgggcccgtttttttgaaaagggatactatgaaaagcacagacagtttttgattgacttttacagaaaaaaacgcgatttgatgtgcagcgccctctcctgtattcccggtttgtctttctctgtcccggacggaggccttgttatctggatccgcctgcctgaatatacaaatgaccggcagattgccgcggcggcagagcggacaggactgcttctcatgccgggaaataccttttttgccgagggcagccatggagagtcttatatccgggtctcctattcctctgtcacggacgaagaaatcacagaggggtgccggcgcatggcagaggtcctgaattcctgccggatctaacaaaatagtgtaccaatattcatattggtacacatatcaaaatcattatggtactttactcctgaccgtcttagtaataaaatacaaaatcataggacgcgcgtatccgtaaatgcagcatattttacttttatcggaaatcaggaggaaaactgaatggaagaattatacaagaaaactctggaccggctgaaggccgagcttaagaaacaactgccggagatagaggcaaatggtgactggctctggcatcacccggaggcaggatttaaagaaacagaaacccagaaatactgtctggaggttctgaaaaaccatggctttgaggcctgtacctggccggatgtaacaggttttacctgtacctatgacaccggaaggcccggcccctgtgtgatgatcatgggagagatggattcacttatctgctattcccatccggactgcaatcctgaaacaggtgcagcccatgcctgcggccattccatccaggtggccacagccatgggggcgttcatcactctcacagagagcggcgtattagagaatttcggcggaaaggtcatgttagccggtgttcctgcggaggaatgcctggagatagagtggagaacccgggaaatccaaaaggggcggctccattacctttgcggcaaagcggaactgctgtaccggggcgcatttgacggcgtggacattgtcatctccatgcacgccggtctgggaaatgacggcacaatcaccatccttggctcccacaacggcttcatctccaaaaatgtcacattccagggacgatccgcccacgcggcagcggatccggaaaatgggatcaacgccctgtacatggcaaacacggctctgactgctctcaattccttaagagaaacctttaaggacagcgatactgtgcgtgttcatccaatcatcaccaaaggcggtacggttgtaaatgccattcctgaggaagtatgcgtagaatgtctgtgccgtgccggaaagacggaaacggttctggatgtttcaaagaaatttgaccaggccatgggggcaggcgcttacgccttcggcgggaaggccctggttcgcacacagcctggttacctgccctaccgccccctgccggagcttgaccaggcagcggttcagacagcagacgatatcctgggcaaaggccgcgtaaacaaaggcggacataactgcggttctacggatcttggcgacttaaacgaggtcattcccggaattcaggtatttgtcaactatatgtatggggaccatcacggggcggattacaggattgcggaccggaaaatatatgaaaccgcatctttatttctggctgccatggcctgccgcctgctggatgatgagggcgccctggccaaaaaagtgaaggcggcccataagcccctgttcgccagcgccgaagactactgtacttatgtaaagtcccttgaaaccgagcaaattttaccataatggacaaacgaggtgaacatatggaaactccatccttaaaaaagaatctgccgctcttaatcacgctgacattgtccggttcctttatctgctctcttccctggttccgttcatactattataatccctttatggaaaccttcggcatgaccaatacccagatgggcctgtgcggtacggccctcggcgtaggcggaatcgccgcatacctgttcggcggaattatctgcgactacatatccatcaaaaaactgattcccgcagccatgatatcaacaggtgccctgggacttgtgatgctgaccattccttctcccatcattatggtaatcattcacgggctgtttgccatcacctgcctgatgctctttttcccggctcagacaaaggcggtgcgtaatctggcatctgtcaatgagcagggaaaggccttcggtatctttgaaggaggacgcggcatctcaaacgccgtatatctggcaatcgctgctttgattttcggccagatgacgattataaaaagcgaatcctttggcgtacgcggaatcattctgttctattctgttatgaccattctcctgggtgtgattgatattgtcctgctgaagggaattgacgatggcaaaaaaggtgacagcaatgatactgtaaacttaaaaatgcttacaaagcccctcaaaatgcctgcagtctggctgatgattggcatcatcttcgcgacattaaccatcagcaccggttactactatatttcaccttatgtaaccgaggtgttcggtgtcagcgcacttcttggcgctgttctgtcctcttcctcacagtacatacgtcccattgcctccttcggggcaggcgtgctgggcgacagaatcaacaattccaaggtcatgctcattggacagattggactcgctattgctctggttattatcctggccgttccgtcctctatgggagtccttcccattctggtggcctgcctgatgattttcttctgcatgtatatgtgcgtaaccatgcattttgccattatggatgaggaatatttcccgcctgaatgcgtgggaaccgctatcggcctgatatgtgccattggctatctgccggaggccacatcaccctttgtagctggtgtgattctggatcattttccaggtgccgccggataccgcctgttctttgtctacctttttgccgttactgttttcggactggtactgactgttatctggctgcgcagaacaaaagccagacgggcggagattctggaaaagctgaaaaaataggccggacggcccagagaaggggggcaataactatgcgaaagaaactgtctgatatgacaaaacaatactcttcattttttctatgtgttatcctgtgttgcctggccgcagaattcattggtcccattaagctctccttagggaggtttaccgttacctttctgccgctgttatacgccatgcttcttatgctggtcctgtatctggcaaaaccggtccggggagtggggaaagcttatgttccggctgcttccaggatgctgtccatgggggttgtgttcgccatggcaaagctgggcatttccagcggcgcttccataaatgagatgatttccgccagtccaatcctgattttacagaacatcggaaacattggaaccgtgctttttgcccttcccattgccctgatattaggcatgaaacgggaagccgtgggcatgagctatgcgctcagccgcgagcccaatgttgctctgattgccgatatgtacggcagtgaatccgatgaatttaagggcgttatggtctgctacatcgtgggaaccgtattcggcagcatttttatgagtattattcctccgctttttgtcacccttggaatcttccgccctgaagccgccgccatggctgtgggggcaggaagttcctccatgatggcggcaggactggcaggtgtgatagaagcatcccctgccagcaatcccgacacgctgacagcctttgcaaccatcagcaatgttatctcatctgcaatcacagtctaccttgggatctttataaccatcccgctgagcaacctgatttataaggtcatgaaaagaaaaggggtaccatcatgagcgaaaaagtatcttttaaaagtctctgcgtggaatgggtaatttcactgactgtaatggtgattctgaccatggcctgtaatatcgtggggtatgggggacggtttctggaatccattccgggaatgctgattctgtgcgtaatcagcttccttggactgacggcaaaacacttcatccccagcagcctgccggctgtaacctatatcggaattatcggaatgctggccgccgtccctgcttctcccgtatccgctcccattatctactggaccggtaaaattgatttaatggcttccatcacccccattctggcctttgccggcgtgctgttaggcaaggactggaaagcattcctgtccattggctggaagggcgttctggtgtcgctgctagtgatcttcgggactttctttacatcagggctgatagcgcagttcatgggagccgggacagtctgacgcacacgggccgccggagtatgcccctaagcccgctgaaagaaacaaatgaccgccagctgaatcaaaaagaaaaccaacaggatcatactgtatctgtcaactgcaaatggcataaggctgataccgttttcctcggtacgcccctgctccttcaaacaggccatatggccgcggattgtataacgccgggcctgttctcctgccggctctccaaacaggcagctgaatccataccctgccagaaaggtcatcaccgtgccaaaggcagaattccacatccaggtaaatccggccaatgttccaaacagcaatgtgattatgaaaccaaatacagcaccgcataccgttcctttgtcattggcctttttcgtaagcatggctaaaagaaatataccgcaggtagggccgcttatataggatatatagctgccgataaccgctaaaatggattttgaagtaccggaaaaggccagcatggtgatgatatataccaggattccccagacggccgataccatcatggaggtctttaaggaggcctcctttcccttttctatatatctttcatagatatctttggtaaataccgtggacatggaattcagcagggaatccacactggacatggctgcagcaaacaaacttgccagcagcagccccaccagtcctgccggcagtcctccgatgaaacggatcatcacatcattggcattttcaaaggcagccccgccaaactgtataaataacagtgctcccagaaaaatgaacaggaaatagaggacattcatcatgataccgctcaccacaaacgaacgctttaattcccgtatggatttggccgtaaacatcctttgaacctgggcctggtcaaaggaaaaataccgtgaccacataaacagtcctcctaccaatgccgcccataatccgttctcattggtcagggaaaactgccagctggcgtcaaatgccctcagcttccctgcctgtgcagccatgtggacggtttcaagaaatccgatattgctctttgcgaacatgaaaaccattccgcctatcaggccgccccatattaccaatatctggatagcatccgtccagataactgccttgattccgccggccattgtgtaaaccaccgcaatcaccacaatgaccggtattatgatgtttatgctgacacccataaaacgctgcaggaccagggaagggacaaaaaccatggagctgacctgaatcagggagttgaggatgaagcccagcactgccgccatccgtgttttaggacccagccggagttcaatgtactcatatacggatgtcagtttcagatcgtacagcatgggcacaaatatagtagtgctgatgaataatgccaaaggcaccgtaatgttctgcatgaacggaagcagtccgctgtgatacccccatcctggccctcccacaaagctgttgcagctaatcatggtggcggcaatggacagtccgattggcagccatggcaatgaacgctttgcaacaaaataatcttcctgggttttgttggtcttccccatgataaatcctaacacaagcattcccataagataaatgaaaatgattgcagcatctatgattgtaaatgtcattgtcatgcctgcctttctattaaatttatatttggtccggttccgtattacggctgagccggcttacaatcagtcgtggttcagaatctgacgtgtcctctcaaaaatatccagtccctgctgtttcagccagtacgggaggtcgattaaaacccagttttcagaaagcttgtctcccctgcggcagtaaacatccaccacctgcatatctccccttcctcctccgggtaagcccagaaatcctccgatgggtgtattggtcaggttgggccagccgaagaagcatgcaaagttgccttccgcaaaccggcatacatgcccgttaaaggttttgtcctttaaatgattgcggaacggaagctggtgctgttcctggtagcgcggaatggtataggaagctccgattccccccggaccataccaaatcatatccgatgcccaggccttttccaaaacctcaggcggacagcccatggccccgctcttattcagctcgtccaggtcgtctaccatcttattgaccagttccagtgtttttatcccttcctcttccggggcgtcttccaacaggataccatcatgatacctggggccggggtagataaaataatttccagtggaaggcggaagtggattttcgccggcctggatcatgagtccgattaaatccacgaacataccgctcttacatatctttccattctctacacagctgaactccgcataacggaggctggccattttcctggtatggcgaatccccagaaaatcctggtcgaatagacccatcagatgtcccatgctcataacccattcctcaccgctgatttcatttgtaccggcgataaagatatcctgtctcctctgcatatggcggagagccttttttagaggtatccagaacgcctccgccacagcctccctgccgttttgctcacggaacgggtatacccccttccaattataatcctcggtcatatattcccggaaaacctggatcacctgttccggttcagccttttccaatgcgtcaaaatatgacaatgctaccttttttgattcctgatattttcccatcttaatcttccttcctcctgcatattatttatctgctgctttttcttttttctgataagtttccggcaggaacatccatatgaccgcgcctgccacaaatactgccatggataccatgaagatcccctgcatccccgctgccgcggatcccaggcctgcaattgcaggaatggcaaaggtggatatgattcttcccccgttaaatgagattccggaggacagggcgctgaatttctgcgggaacaactccgtataataggcgccccaggcaccggaaaagccgaccgcaaaccccaaaaataccgataccagcttgagctgggtaatattcccggcccccagcctcataaagaggaacacaaacacagcgctgagcgccatgccaatcaaaggttttttccgtccgaacctgtctgaaatgaatccccatatgttgtaaccgattaattgtcctatgccctgaaggctgtaaatgcctcctgcaactgccgcgctcagccccagagagttccgcaggtatgtagtggcattgttggaaaatgccgagtaggctgtaaagttagcgccggagagcaggatgacccccagtcctatccacagatacttacccttatacatgtttaaatagctgattttctcattctgctgtttggatacttcatttaactgcctggtattctggtaatcgttgggtacaaacaggaaaatcatgactgcccccaccgccggaggtatgatggctgtatacatcagcacctgccagttggaatcccccataaacgagtagagctgccccccgaaaatcatggctaaggaaaagagactggtcagaaccgcagccagcttaccgcggtatttctgcggaaacagttccgtcaccagaggcatggcgcagccgaatacacctcccagggtaccgcctgtaatcagcctggacaccaaccatacctgataactgccgggtgtcatcatgggaaggaatgtggtcagcgcaatcagcgacgccactacaatcaacgtatacttttttcctatctttgcattcagtatgccgaatacaatggtgccaggtatggtaccgaaggacataaccgcaaatatggtttccgactgctgcaaagtaaatccgaacccgcctgaggctgcttctgcaatcatggtaggctttacaaaggttcccaccataaaattgtaacaataaaaaaagtatacaatgactatggacaggaatgcaaggctcctgcgggcagccgacaaattctttcctaaaattatgtcgtttcctgattcaaaggtattaattgcggttgcagacatttatctctctccctccatcatgttatcttctgtttttacatagctatcctctgtctccagataaatctgtttcagtacatccagtccgtcaaaagtaacccattcctcctgaatccgatttcccgcaacccggtagtgattaattcctaatatatccaccggcttcatggacggcgccccgaacatcccgcggccttcatgcagtccccgcagtctccatctgacagccacatcccattcatcatccccggcccgcctgttacaggtcacacggtccacgctgtgatgcgcattggggaaggatgccaggaggctgatgaccatgccctgaatctcctcatatccaaccaggtctttcccgcatatatagtggactgctgcatcgggcgcataatatgtcttgatttcgttaatcattttatagttaaacaccaggctgtgcatttccagcatcatttcccccacactgtcgtcagcggccttatatttttcagggaagaactgcccctgcatggattcgcccagtccaaaccgggactgcagtgcaggagtcttaccctttgcccccctggccatattcctggcaacctcatggacatcaaaccccagctgctttaccagccacaaattgtcccttaccagccactcctcgtaaatacggttgttttcaatggcgcagtcaatgacagtgcggaaattaacctttttccctgtcgcctttccgaaatcactgtccccaagattagtggctgtggacaggaccctgtgggaggaaagatatccctttgtatcatgttttgaccagattacctgttctccaatcagacggcggtccggaaatgaatgcagggtcatcagcgtatttgcaaccacatccttaattccaaccagattagaggaagcacaatgcatggttacatcgttatggtacgtgtcataaattaccccgattcccttttcttcccatattctgtgggttatcttaagcacatagtccacaatatcgcggtactcctcgtcaaaacccggcagctgctgctttgagccagccagtttcagatagtcattgtaatccgcatgtctgaccgggttcacctcctccgtctcaccatagtaaatcttaccgctgctctttggcttctccatcattttcgttcccttctcctctccttttttcatatctgtctgacccggaatcaccgggtccaaaatacctgtttttccctctgtaaccctttccttttcctgcataagcataatatcctccttttttcaaacgtttgaaattattgattaaaacaaagccttttacaaggctaagtgtgaaaacatagaaaccataaaacatcctattttacaggaccggcctgtgccgcgtcccgcacggatccccgtgtgattaaacgcggataaattttccgcggactcaggtcttctcttccctcaatgcggcagacaagggaatttaccgcattggtaatcacttcttccctgggatctgcaatggtgtccagcggaatgtccagataatgaatcaattcaatatcattataccccacgattgatatgtcctccggaacattcatcccatagtacttttttaactgctggacaatggacaaggccggaaggtcctgctgggaaaagatacccgtaaatttacgtatatattcaatattctgtcttacaaactccttctgggattcaaaatccatgcgggctgtcaataccgccggctgggcgccgtattcctccatggcttccatgtatccggccgtgcggtcatcatacattttcagctccgggtcattggaacggatggtcaggattttcctgtggccatgctccagaaggtgctttgtagcccagtatccccccttcctgttgtcatcccaaaagaaatgatccggtatatctgcggaaaaggaaggtttaaaatacacatatacatatggaatgtcagcatcactcaggaatttatattcggcctctgtcagggttttggaaaaaataacaaggccgtccaccatcttcccgttgaccattctgagtatattactctgggaatgtatgtttttattaggctgtatcaaaaaatcatatccgcagttttcaacagctctggtagagtaagtctcaatctcattgaaaaaccaccggtaatcaggcgcattaaagttatctgaaaatacaatgccgatacggtttgttttttttgtcaccagactgcgggcattggcattaaaggtaaatcccaggcgctccgcctcttctataacacgcttttttgttttctccgcgaccctggggtcgttattcaaggacaaagagacagtggaatagctgacatttaaatttttagcaatatctttgatggtcatacaggcctctctcctccccgatttcttacccaaagtatattttaaaacgtttgaaatgtcaatagacagttctatattaattatattttgtacttttttcacaagatgtattggctattttatacagtgtatacatgagggcccttacatggcgggtaaagtaaaacagccggccgtgcggctggctgtttcactttatgatcggttatactccggcaaatccttctctgcgcactctctactttaacaatcaattcactgagcattttagtccccttctttaaagcctctatagatactgcataaaaattatatcattgtttttatgcagtatctattattatttggacaaatgctgattgtgacaggctttttccgtaacacaggccgcctagccgtgcttcccatacatagaaatttctttcatctgcctggaatcatattcttttgacacctcggccgggctgtggccctgacagagcatctggctcaaatcccgcaccgtatcccacacattaaaatgcaggcggaaatcctggtttggtatctgactgcccttgacaacacatgatatgattgaatcggactgggggatggcaggagccgtggcatttttggatgaggatatctttcccaggttctgggcaaatgcgtcaagtatctccgtctgtcccagggcttccacaaccgtaatggctgcttccaggtgctttgcgttcggattgatggccagtctctggtccgcccccaccacgcagattgaaccattttccagcagtggaagaggcgtcatctcaatctcaaagggatacccctcaaaggttttgccgcggtaaattgcacagataaaagcacaattttcctgtgcgaaaaattccttctctccatcactggagggtatcgtgtcaagtgctttttccgggtccatatatcccttgtcaatcatcatctgcagaaaatcaaagccctttctcatatactcactgaccggtgtggtgccctctgacagctcctgcagcttttgctccgtcccttctccctgataaacgtcataaaggcctgcgcacatgacgggaaccgttagtccaaagtccttattggccccatagggaagaatcccgttttctttcagcgtttcacatacattcagaaactcctcccggtttaccggcactgcaagatcgtattgcttcagcatatcaacattccatacaaagccaaaacaggtataggacaggggaagggaaaatacctttccatcatatgtactctgtatcagcgcatcctttgacagattcctgatgcactttaagtcggacagatcataaatatatcctttttcatcaaactccagcacatcctccgcaggaatcagatacaagtcatctgctgttcccgaagacaggcgttttaatagaagctcccggtacgacagaccttcgtccgcataataaccggcggaatcgctgtatacaacaatattcgtggttccgtctttattcagtactttttcacagcactcctttaccacttgcgaaaccgaatcattctgggtgaaaattgccaccggtgtttccggaatccctttatccagatacaattcaggagcagcctgtccatttttacatccggctcccaacaggacccaggccaaaagaaggccagccagatatccttttctcttcattatatttcctccggttcctgctgattgttcaaaaatctttggagcgtactgaataatttatccagttccaccggttttccaatatgcgcatccatacccgcctccctgcatctgcgtatatcctctttaaatacatctgctgtcatggcaatcacaggaaccgtggctgcatccggcctgcccgaatccctgatagctttcgttgcctccagtccgttcatctccggcatatgcacgtccataagtattaaccggtaataccccggactgctgtttaaataagcatccaatgcctctttcccgttgcaggcagtgtccaccacagcgccgtggctttccagtagttctacgattatctcccggtttaactcattatcttccgctgccaggatacggacaccgttcaggttttcccaatcttccggtgcggattcctctgttttacttttactgccctggaaaaagtaggccagctgtcccagaagttcatttttaaaaataggttttgtgaggaagccgttgattcctatgcggacagcctcatccttcacgctttcccaatcataagctgacaacaggagaataggcgtcttgctgctcagacgttcccgtatctgccttgctgtttcaaggccgtccattccaggcattttcatgtcaacgataagcataccgtaatctttcttcatcacatgggcatcccaggcctgctttactgcatcaggcccgtttaaaacccatcgggcccttatgccaatctcctgaaggatcagacagattccctcacaggcatcctggtcgtcatccaccacaagagcagagtactgtgtcaggtccggaatttcctgttccggctgttccggctgaaccggcagtttcagggggatgtccacggtaaagcgagaccccttgtttttcctgctctctacgcgaatgctcccgcccatcatatccactatgctctttgtaatggcaagccccagtcctgtaccggtgacctggctcatgcggctgtcctccgcccgttcaaagggcttaaagatacattccagaaactcagggctcataccaatcccgttatcactaaccacaaagcgcatccctatggtatccgcgtccatggggttttctgtaatcatcagtctgatttccccgccctcctgggtatatttcactgcatttgataataaattcagcaggattttctgcagatgcagggtatcgctgagcactgtgtcatgttccagtacaggcgatttcatgtacaggacctggttctttttatccatatcaggtttgataaaggaaacaaggtttgcaatcaggctgggaagatttacattttcttccttaaggctgagtttcccgctttcgatgcgggacatatccagcacttcattaatcagccccagcagatgctctgaagctgccataatcttattcagacaggactctgtcttttcccggtcatccagattctttaacgcaatgtttgtcatgcccataatgccattcataggtgtcctgatttcatgggacatggaggaaaagaacgctgtcctggcccggttgctgttctgggcctgtgtaagggcatcggccagctgttcacggatatcatgttccccggtggtttcatggaacacagccagatactggccgtaatccgcaggaatcagatggatctctatccatcgccttacctggttgggaccagcacccaccaggctctccctggtaatctgttctttcagcattcctttcaggaaaccgttcctggcagtgtcctttttcgccattccgcccgcgtcaaataccagctccggcttttcccgcacctcctgggcagtaatgcccagaagtccgggcaggttctccgacaccagctccacctttccaatggccggcgtataaagcaggaaagcgaaatctatatttgaggaaagattttcaaacagcttctcccggtactccttctggagcacatccgccttcatggactgccttcccgccagcagcgcggctatggatatgcctgacagcaaaagcaggcagaacatacagcaaagcatggtgatgatgggagccgcttcctgctgaagcactgtgcgcgggacaaccgtaagcagataacagccctccggcgcttctaccggaaggaaacccagcagggatttctgattcccattcatcaccgccatggtaccgcttttgtgtcccccgatgacctgacgaagggtatcctgaatccccctgccgttgccctgcttttccagatagctgtaaatattggactcggatgaagttcctctggattttataataaaattcccctggctgtccaccacgtaagcagaaccttccccattgtggaaggaaaacagattaggaagattatagtcgtttatgatccggtccgcgtaaacatcccctatttgttttccgtccctcatcacaggatgctgaaacgtaacctgcagccatccgctggaaccgtgatagggagccgatatcccgcccaatccctgggaacctgctgtatcatcaaaggaaaattccaaatccgaggcgtgaatggtatttccctggctgtctatcccattgccttccacatccacaaaagaaaaacggaaaaaatcagtggagtccgcatacttttccaaggtttctccgattgcgtcctcctgctccagggcaagcagctccgccaaggttcccaatagtttcctgtcaaggacgatttcattattcagtcctccccttataacccggctggaaatcagaagattctggtttgcgctgagattcatcctgccgataatctgtaccagaaagaaactggaaagggacagcgcaatcaggaaaatccccgccgccgacgccagtatggcatatgatttcttcttctcccctgttcctgctttcaacttatgtacctcctgaattttaggtaaatcccatatcatccgttcatccatatgttagagaacatctgtctgatgcaaatgcattggacgtcagcgaaggtatcacaatatctttaatcgctcacatccaatattaatacgagtatagcaaaggttgtcataaatagcaataaaagtgcaaatattgtggaaaatggaaaccggggatgttatagtatttaagcagggcatcatagttagagtgaaagaaaggtaagatacagatcgtatatacagagagaaggtgaacagatggttatggactgcggaatggaactgcatcaggcaatttatcagttttatctgacccagattcaatttggtttctatgagcatggggaaaaactgccttcactggaagagacatgccgtcaattccatacatccctggatacggcaatccctgtgtaccaccgcctgcgccatgagggatatattaccctttccaagaagggcggggcaaaagtaaccgttacctatggtcaggaagagattgaacgccatatacagtccttttacgctgagcgtaaggaatccttaatcgacctgagcggctgcatatggccgctgctgggacaggcccaatgcaacgcctttaaatatggacatataaaagcagtggatttctctgacttcttagatgaggggaatccccaggcagtctatgctgtctggaaaattttagaccgcaggtacaacgccctgggaaataatctcctcatgcggctcacccgatacctttatttatatttttacggggccttctggggcgtgattgatgacagtgaactgcagaagaaaaccttattacaggtcaggacagccataaccctctgccgcgaggagagatggaaggaacttcctgattgtctgcatgtggttcaggatgaactttccagtgctctgcaccgtttttataaggaacggatcatccgggagccggccggcaatgaagtggtattctgctgggacgcctataacaagtcctcgcagcttcgctattcccttgctatggagcttctgacagagatcgggcgcggcatttaccctcctgggagctatcttccttcggctgaacggctttcggctgagaaaggagtctctgtcagcacagtccggcgggcagtctgcctgttaaacagcatcggggcagtcaaatcctcaaggccccttggcgcccgtgtgctgacaccttcccagagcgctgaaaactgcgattttacccagccggaccttcgcagacggcttttggaactggcggaaagcctgcagatattcgccctgtccggcaaggcggtatcggaaatcacactggcctccctggatgacccatctctttgccgttggaagcaatgtctgtatgatttaaaaaccagggggcacagtgaaagattaatatacacctgtctgtcattgatttcagagtacgccccctttcagaccctccgtacggtttattcggagctgctgcgtctcctcttctggggaaacccgcttcaggaaatgctggagacgcagtgtccggacagttcacccttttttcattgccttgaacgtatgcttacatgtctggaacaaagagatgtcccatgtttcgcctcaacactgcaattccttctgttgcatgatctgcgcagaatcgtggaggtcctggagaaattgggtattgaggaggcaacgaatattttaattccggatatagatgatttttaagattatgaggtcatacggaaagaagcaaagcctgacatacccgccgcataacgcgcttggtctgtcaggcttttattgttccgggataggaggtgcttcacagacactcctgtaccggaggttgtggaaacgaatgcatatgaatccttcaccacagcataaaccgtcttgcggtaaacgccctcgcggagcgttcaaaggcactgctttttgccgtggttagctccagggcaagactgatggcaataccctttttcttaggcccgaaccactgattgattcataactttggcactggagtgtctttaagtaatctgctgcgttattaaccctgataaatcctggtcccgctttttcccaccatagctaacggtgctttctccagggaggcgataaccgcgtttctccctttcttactctccgcaaatgccatggccgcctgaaccttgggcagcatgcttcccgctgcgaactggccctggctgcagtattctctggcctggtccaccgtcatctccgtcagctgcatctggtccggcctgccgaagttcacagccacatgatccactgcggtaagaatgaacagatagtccgcatccaccagctccgccagcttggccgaggcgaaatccttgtcgatcacagccggaaccccggtataatccccgttctcgttcttaataaccgggatgccgccgcctccgcaggcaatgacaatatactcattgtccagcaggtttaatattgaatctctctccacaatggtcaccggcctgggggaaggaacgactctgcggtagcctctgcccgaatcctccacaaactgaagctccggccgctccttcttaagcgcctccatggcctcctttgtcataaaactgccgatcggtttggtggggtttaaaaatgcggggtcccctgggtctacggccacctgggttactacactggccacatgccagggcattttccggattctcagctcttttttaattcccttttgcaaatgatagccgatatacccctggctcatagctgtgcactccatcagctccatggggcagatgcctgaatcatgccgggcaccgatctcaaaggctttgctgatcattcccacctgagggccgtttccatggctgatgataatctcatggccctggctgatgaggccgatcagggaggggcaggccgcctcaatcatctcctgctgctcctctgggctgctgcccagggcgtttccgcccagggcaattacaattcttgacatgctgcaattcctccttgtttagccttcgtatacaatgcgtccgtttaccatggtgaacacattttttgtatccagaatcacttccggctcgccctcaaaaatgttgtggtcaagaacgcagatatctgcgaatttgccgggtgagagggtgccgatctcgtctgcgctgttggctgcgcaggcggaaccataggtgtaggcgctgactgcctcgtatacattgatccgctctgcggggatccagccgccatccggtttgccgtcaaaggcggaacggcgggttactgcattgtaaaggccgttgaagggattgatctcaaccaccgggctgtctgttccgaaggccagggtcacgcctgcatccaggaaacggcggaagggccacattaactggattctgtcctgtcccaggtcgcgctctataccattgggatcgatcatcaggtggggcggctgcacggatgccaccacatttaacttgctcagtctggcaatatcctcatactgcagattctccagatgctccagagtatgctgcagataaggtttctttccgtagaccatctccgcttcctctaaatagtccagcatcaggtgtatggcctggtctccgatagtatgtactctcatgctcagatcattttccactgcctttaacaccagacggcgcatatcatcaggattggtggacagtttgccgcagtcgccttcataataggcatttgcatagggctcttttaaataggcggtgtgacagctggacactccgtcaaagaaatgcttcacgccggtgcattttaacatggggcttctgtactggtcccgcatttccatgggcctggtcatctcatcggtcatggtgggatacatatggacgcgcacatttaactcacctttgtccaacagcctggaatagatgtcgtcccgcacaaagtccgctccgggcaccgccatcatggatacatcgcacacagaggtgattccgaacttgtttaagttggaaataagctccttgtagcactggtcttcctcctcctgggtgaagcagtaaaccttgctgctgaggcaggaggccgcactctcatggaaaatgcctgtcagttcgccgttctcatccttgtcaatggtacctcccggaggcgcctgggtgtccctatcaatgcccagtacttccattcccttggtattgatccacatggtgtggccgtctccgctgaccatgcataccgggcggttggggtatactgcatccagcgacttcttgctgggcagcaccggattttcccaaaggggatgataccagcctgcgccgatgagccagcggtcctccgggatacgctctgccagctcccttaatccatccacgcactgctgttctgaagtgtcggtaaagctggcgtgtaccaatggggaggagtaaagcccggacatgtacagatggatgtgggcatcgtgcatacccggcataatcaccttatccccaaaatccatgaccttggtttccggcccggtgaacccttccatctggtcaaaggggcctgcaaacattatcttctctccctttaccgctacgaatccgtctatcagttttctgcctgttcctttataaatccggctgctctttaaaatataatccgcttttctcatcatttttcttcccctccatatttcttaaccgcttcatttcatacactgccataactgccgctgctgcaaaggccaggatatcagccaccggcagggagtaccacacgccgttcaccccgaaggtcctggtcagaaccagcataatcggtatacagaacaggatgtagcggcagattcccaggaatgtggacggaaccacccgctccacgtactggaagtaacaggacatcacattggcgcacagccccagggccgagcagataattgccatacgcagtgcaggtaccgcaacctccaccagagctgcatccccgcaaaacacatcgcagaccacatgggcccccatgtagaaagccagggtaaacacccccactaccagaacatttccaatcatgctgaccttaatcagctgacggattcttccgtacatcttctcgcccagattgaaactggcgataggctgcatcccccctgtgacagcctgggtaatcatcatcagaatgtatatcacatagccgttgatcaccgcataggcggccagatccataggtgttccgtaggctcccagaaagttgttgattacaatgccgaacaccgtgctggaggcctggaccaacaggaacggaaaaccgattttcatgatctccataatcaggttcttgtcaaaatgcagatcctctttgcggatcttaagcaaggtattcttgctgaaaataaagtaaagaataaacaagccccagattccgatggagatggagtaataaaccgctcccccgggaattcccagttttaatatgtatgtgctgacatacagccaggcaagcgcaatcaccgcggagctggtcatggcccaggtggcaatggccggcttctcatctactcttgccatgtagaccacaatatgtccaataacacagaagggatagcccaccatgaatatgcgcaggaaaataatcatcatgtccttatattccgccggagtacccatcaaatccgccacagggcctgcaaatataaagataatcgcggacagaataaccatggccagcagggtaaacagggttccttgtccgtatgcccttcttgccccttccgggtccccgtttcccaaccggattccggcgatggtggagataccaatggcgaaaaatccccccagtgcaagcatcagatactccataggcataatcagttccacgcaggccaggccctcagttcccagcccatttccaataataattccctcacacagcaccatgatgcactgagcaatcattcccacaaacgtgagaaagctgtattttgtaaataacggcagaattggtttcgtacccagctctcgcccctcctgctgttcttgtcgttctcccatatcaatgccctctcctttccggttaaatgaggcctctttcttccataaagcgctccagttcctccttggcagcctctgccttcagctggcttggcgcctgctctctctgatactgggtgaagtacaccagcaagccgcgcattgcggtcagtcggtttcccgcctcctcaaatgccagagagcactcgctgtccagcacctcgtccgtcacatcctcgcctctggtggcaggcaggcagtgcatgaacttgcagccgatgctggccatctgcatcatctcacggtttacctggtagtcgtggaacacgcgtacccgctcctccttgggcatctcgttctcatagaggccgtaccacacgtctgtgtaaataaaatcagctccggtgagggccttcaccctatcgtccgtcacatcccaggttccgccggattccctgcagttctcctccattatcttcttgtgctcatccagcagctggtggccttccgggccgtagtgtacaaagtgcatgcccagcttggtggtgatgaagccaagagacgcgcacacctgagtgccatcgcccacaaataccaccttgcaatcctccagcttcttgttctttggcaggttctcaatgatggtgcagagatcgccgatttcctgggtaggatggttataatcagacattgcgttaagcacagggatgctgctggcctgcgccagctccacaacgctcttgtgctcaatcacgcgggccatcacaatgtcgatcaggttggaaagcactctgcccgtgtcgccgatggtctcatggccgcccagctggatcataccggggccaaggtactgggcatggccgcccagctgttccatagcagtttcaaaggacacacgggttctggtggaggactgctggaagatcattcccagtgtctttcccttcatcagaggcggattatagcctgctttgatgcactgtttgatctccagggacagatgaatgatgtccagcagttcttcctttgtaaagtcgtttgtgtcgataaaatgtctcaatgttttcatgatgattcctcctgttttttgatttataatagtttctattttcctactttggctgctgctgtgtgatgcagtggatgtttccgccgccgaatacgacttcctttgtccggacgcccaccacttccctgtccgggaacatttcccggatctgggcaagggccgccccatcgttctcgtccccgtactggggcacgatcacgccgccgtttacaatgaggaagttcatataggaagcaatgcacacgtccccgtcctccctgggcatggttccctgaatctgatcaatgccctcagcgccctctaaaagcactggtttttttggcaggcacagcttatgtacctttagttttctgcccctggcgtccacggcccggcagagctggtcataggcttttctggaagcctcatagaagggattctcctcatcttccgtgtatatgcaggccgcctctccagggcggatgaagcatgccacatcatcaatatgcccgttggtctcctccgggtcaattccgtctgtgacccagatcaccttctcacagtttaaatagctgcagagcatctcctcgatctgttctctggtcagctgcgggttgcgtccttcactcaacaggcacatctccgtggtcatcaccgtgccctccccatctacatggaaggaaccgccctccagcacaaatccctccgtgcggtaggaatccacgttctcgatctcacacaccttctgggccaccgcatcgtctgcatcccacggaaaatacagtccgtccaccaggcctccccaggcgttgaatgtccagtcaattcctcttacggtgccgtcctctccctttataaaggtaggaccgcaatccctgatccaggaatcgttgcttgccatctccaccacccggatctcctcgggcagcctggcccggcagttggcgtactgttcctttgatacgcacatggttaccggttcaaaccggcttatggccactgccacatctgtgtaggccttctgtaccggcttggcgccgttcctccagttgtcctgccgctcgggccagagcatccatacctgcttctgctcctcaaactctcccggcattctgtaaccgtcttcctttggagtggaccccataattcgtttggccatttcaaaaccccctttatttatttttctgcggccggtgcggcgtatttggtgcgccgtcaccggatgacacaagactaccacccgggacggctgttttccatcatcccaggatgtattttcatctaatccataggatgtatttttttgtaataattgtcaattatgtccataaactcatctaatcttttgtatattttcaataaatttcgggaggtttcgacagaatttcaaattgcagttccgtctttttaatggtataatagggacactattccaaaaggggacgaaaccatggacgtcatctcatttctctacacaattttccttctgctcctgtatgcctgcgtcatcagcagctgcttttatgcctggatgaatacagggcataaactataccttcatttgatcgcactgtttgttttctttctgtttgatctgtccattatctccattattgagtttatataccacacaccgggacagttttctccggtcccatccgtcagctttccgctgcttcggaatgtaggtttcttcagcggaatgattatctacacatttttctttctgtgcctgatggagcgctcctttgagctgctgaacctaatccccctcctgatttacgcggcctgcatggttgtattcggcaccatcagaaattctgcggcggctgactggatgtactttaccgcacgctatgtcaccattatcagcctgctctttctgctgcggattcagatccgggcctgcggcgaccggatcgatgtgcagcgcagggctctggccctgcagctgaatctgtttatattggtatttatgtgcctgtcctttgtggaaaatacagtgactactatgtactggaaggaatactccggctggctgaattcgtttgcaccaaggctcagcgaacggatcttctgtgaggatatgtactctgttatcctgtcctactggtgcctcactcagtgttatgatgtgattaaaaacaagctgaacacagctgtcctgcctgtcaatatgtcctcagccctgcctaaggattgttatgacagcgctaaggaggaatttgcacagaagctggggctgacgaagcgggagcgggaaatcctggatttgctgctaaaagatatgacgaaccaggaaatcagcggagagctggtgatctccctaggcacggtgaagacccatgtccacaatattcttcaaaaggcggaggtcactaagcgtacccagttgatggagcagttcaggaattttgtacaaaaataaaaacccggtgctggctgcactgggtttatagatatcaaaacggcctatcaatggtcatgcccctatcagtggggtatccggggttcgccttttataccactttcttttgccggcctaacgggcctttctccttttatatgtgataattaaaggcggaacacttaatcaaatgttccgccttccaatcccttatttatctatcttctgattgactgcatacagcacaatcctcatggtcacttccttctcctcatcaataaccagagtgaggtaatccccttctttttttaccacccttccaactacccctccgatggtgatgaccatatcccctgcagcaatggaattatgcatctcttgcatcttcctgtgctttttcttattaggtatatatacaaaaacatacattgccactatgacaatgacgccatatgcaagaaacaataaccctggtgacatatcttaaaagtcctttctgagccgtatttattacattttgaaaaacctttcgactatacgtacaaatatggcggatccaatccagaatacgtcctcgtccacattgaaaagcggattgtggtgcggtacatctgtgtgtttctccgggttggatgagcttaagaacatgaatgctcccggcgctttctccagataatatgcaaaatcctctccgcccatatttggcgcatccagatggtcaatgaccatatcatctcccaccacgtccctggcacagtccgctgccagtttagccataccggcatcattgataacaggaggcgcaccccagatcatttcgtactcagcttcccctctgaaggctttagcagttgcctctgcaatctcgccaatcctcttagccagctcctggcgtacatcttcctccaaagcccggatagtaccttcaatcagaacctccgacgggataacattgtaggcgaaacctgctttcacatggccgatagtgagtacggaaggcttaactgccgggatctcacgggcaatgatctcctggagattgatgatgatatgggctgcaatgttcaccgggtccacgcctttttccggagtggagccgtggcaaccgattccttttacttttatcacaaatttatcaaaggaggccatacagcagcccggtacggaaatcacggttcctgccttgatgtccttggaaataattgttccgatatgggttccgaacacagcatcaacgccatccatagcaccctctgcacaaagcctctgagcgcctctggaaccttcttcatcggtctggaagagcagccttacagtgcctgggatctgatctttatgttcacttaaaattttagccgcccccagcagcatggtcatatgcgtatcatgtccgcaggcatgcatacatccttcatgtctggatatgtagtcgacctcattggcttcctgtatcggaagggcatccatatctgcacggagcacaatggtctttccctctttttctcccttaatggtagcaatgaggccgctgtccgtcttattctccacaaaaggaatccccagttccttaagcttttcttccacatacgccctggtcttgggcagttctccgcccagctccggaatctgatgaagctccctgcgcattctgaccagctcttcctgtaattctttacatttctcccacatgataatatattactcctttcctgaaattagattgccgcaacccatgattatttgacaagtccctttttatagaatactcttgcgattaacaaggtaccaaatacggtgcacacaataactgctgctgccggaagtccggtggtcattttcagaattacgggaattgccaatgcaaatactgccacctttggatatttaaccgcaaaattcccgaaggtcgctccaaaaattgcggaactggcatatttcgtaagacctaccactatgaactcaggaagcacagataaaaccgctccgcctacgataactgcagaagtggtgcctatcaggtttgtaatgatagaaccgcagattgccatggtggaaaccacctctgcctggattgtacctggtgtggaatgtgtaacatccagggccagagccgcgcagggaaccctcatattgccgatatttcctgacaggaagctaaggtaggttccggtcataccaagagcggcatagtaggaaaccggctccacaaaataaaacgctccaaaggaagcagcaaccatgccccatgcagtaaggaccgtgctgattggcggccagcaatcataagtggtgcaaagccagataaccggaatgaatgaggtcagggcagccaggatgttcgtaggtgagccaataacaatactgctttttttccattgtttcatgatttcattatcactcatttatcttccctcctggtctatttgagtaactgatcatatcccaatgcgaatatcatgccaatgatcatggcgatacccagggaatattccatcaatttaggatattttttacatacggttttcacaagcaggaccattgaaacagcacctgccaaaactgccagtgtatttcccatcccctttaagatttcacctgcgttcagataaccaaaaataccaagggagcacgcaccgctaagcacaaccagccatttcatatctccaccggataccttattgcgcagcgtctctaaagacggagtggcaacaccggtaaagagaagccagcctgcgccgtttaaggccatggtaaaccatgaaaccgcaagacagagcagagtatactgctctgtccccagagtaactccacatgcttctgcaccaatatttgctgctgaaagctcagtggcagcagcgccgatgatggaaagacggagccacgccatggggcctccgatggaagccataagtccaaccattacgataaacacacccaaagcaggacctatggcggatatcagtcccacgcggaaagcttccttgggaatcttcggatccagacctgccgccctggtagtcttgctgcactgcctcatgtaaagcactgtctgtatagcagatatgacaaccgtaacgccgcataagagccacagaataggtgaattggaaacctgttggacttgctcaatattactcatttcgcaacctccttgcataatgatggtatagtcaattggactacacgattaacgagttactataaatcttataaacatacacaccccccgtcagctgttaatttacatcagccagtgatgtattaaattttgtttgaatttaacagatttagaagcatatccgctaaaacctctgttcctgaaactgcatcattgatatctgtatattcagccggatcatagctatctccgatggggcccggcacaaaacgcataccctcaggtgtgaatgcagctatatataaatagttacggtatgcaccgctaatcactttatctggggcaataccttttctctcgcagcattcttcgatggcagccattattatgtcatctgaagaatgaggcaggtctgtttcagtctcttcgcggatgtccatgattccgattaaaaaaccaacacacatgtgaaccgcaccagaccggggcctggtcaggatttgtgcccatcagggtcccatggatatttcccacagcgtcctccgtggcagccatgccagcataggacaactgttacatattttaaaatgatccaaaatcattatttattctgctcttattagctattaatgacaatacggttctccctctctttcatttccgaaaatttcaccaacaactgcttataatcgcagaaacaaactgccttttttctggttattcctactttttttctgcaaatttatatattcttctatatattatcattatttatttgtacagtcctggtcaaagtgcacatttttttcatttaaattcaaaaaactgcacattgcttaataatatggcagctgatataattacatctagttgttttagaaaggatggaacaccatggttacagttgcagattttacatcagaccttgaacaaatccgttgtgttgccggattttgcgggacaaacagagaagttacctcgttcaccataatcgacacacctgaaattctggactggctgcatggaggagaatttgttgtggattccggatatatcaccagtcataatccatccatgctgaaaggttttattgcttcccttaagaaaaaaggctgcgctgcgcttggtgtaaaattacatcgctatcacaacgagattcccggcatcatacttgacgacggaaacaaactggattttcccatatacgaaatgccatataatctttatttttgtgattttgcttctatgatttataaacgtatatttgaggagcagctagatgatatgtaccatgtttccattgcatacaaggatattgtcaattcattcagcaagtataaggtaccggagagaatgctgtctgagttaagcctggtgcttagaaatcctgttttcctgataaattcacagtttgagctgatagaatattcttatggcccaagtgacgatttttctttgcagaacctccttcacagagaagttttgatggagctggatataaatatacagaataatcttttgaaaaggcatcagcagcagccataccaattccaccaattctctatcagcagcccaaatggtgaaagaaactgtattctgttatcatcgggaaacattgacggagatacaacgttcttaattataccggagataaacaaactggaagactggcattacagggttgtaaaggatgtatcggccttatttcaattaatagctaataataaagtaaacacccaggattttgcggcatccgtaatcatggcgcagtcaaattcaaacgaaacgattcttcgctattgcaaaatgtacaattttgattactccaaacaccgtatttgtttatccatagaatttgacagtgaggtacccaccacatccacacgtaaatatataaccagagaaatcttctcatccataaccacctggatcatgaatacctatggatgcaacgtttttttcctaaaaactcacacccattatgttctgtatctgctcttttctgatgtcatatcacaggaaacagcagaataccaggcttcggaagcagcaaaaaaaatctggcatatttttaatcacaataatatttccacatatattggtgtcagcttatattcctctgatctacagcagatttcaaaagcgttttttcaggctatcgacgcaatgaaattgggcagaaaactctatccggaagaaaatgtgtttttattccgcaccattcaggtttaccaatggctctcgaccatgccccaggaaagtctggaggaaatgtacagagataccatagagcccttaagcaaggccggtaattccgatgtcaattatgtccatatattgagaacatatatcgggaatcattataacatcagcaaaactgcgtcttatcttcatatccatcgcaataccctgatgaattatctgaccagaattcaggaattgctgccttacaatatcgggctgcctgaaaatatgctgaagctgcaaataggcatacatgcaatgtatttattggacagaaatagatagctataccctatcttttagattattcgcctgctcttggcatgcggctgtatttactgttttatattaaaaacggggatgaaaaggccctggaagaatcatctcccagggccagggtatctatttcctgcgctccctttgtctgtaatagctgcttcagaaagaaaaacctgtgcaccataccaacgaagtatgattataatgcccacacagcccgggagagcttttttggaagaaactatgccgatttaccggcgttagggctttcccgctctgaattcgttgagatggatacggtattatcagcaaaaggatctctcaaatgtatccttaccatatatttccccggtacagagctgagcctttcccatctcatgaaccgctttactcccggcgctgtccggcttatatttgagcaggtacagaaatccttaggcggggcttatgaattcatctctgtgtttctcctgatcctgacagaccccggagggattcggggctccggaccgcctggagacggtcccggacggtatgcagaggaccagcatttattattgtgccctatgcacagcaaccagaacggcggcattgagaacgtccacaccatgcttcgcatgatactcccgaagggaaccgtttttgagccattgacacagtgggatatcagaaaagctgtaaatcatattaattccgttcctcgggggaacctcagcggagaaacaccatatagagcggctctaaaaaatatggccccgatatactcgaggcctggcagcttacattcatcgttccagatgaagtgatattgtcacccaagctgctgtaaaataaaatcacttaagaaaccaccgcccggccggtaactatctttatcaagtcaatctgcggaatttagtcttgcatacggaatttaaaatttcaattcagccttttcttatttcttttttttcttcctataatcaataaaattccaacggttccaaatatcaacactgctatggtattcttttcaaaatcctttttgtaagaaagtcctatcccacctattcccgcccgattgtagaaatttgatgcccttacaacatcatcataataataaatggagaaaccgtttatgttatcattattactattctgtgcatttaaaggtgtagctgttttctccctattttttgctgctgtaggccattccccattaaatacatgtgtcgtagacttctgcgcaggaatcacaaattcaggtttttcatcagcattaaatatgatagctgcaggatatcgaatgccaggaagtcctgagacaacttcgtatgaatactcatcactgttgtaccccgcctcctcaagagaagttgttacagtattgtcataatcaaccgtttctgcatcatatacatagacagctcccacagtccaaatatttaatttctgtttgagcgtttcttttgcatcttccggaatatcatcaggaatggatgttaccttggttatatcaaccagaattgtaaaaccgtctgtgtatacgggaatttgccacttataataactgttttccaatgattctttaaaatcatttgtttttaacaactcggaattggcataaactttatatgctctttccatttccacctcatccgcttccacatcccggttgagttctccacgtgctccaccataattgatatgatataaaacctcatccttcatagaaagaatctcctgatactcgtttccttctgaaggtatcaagcgttctgatgcatatgacgtaaaactgagattaagcaataaagagatacaaacaaacatgccgatgattcttctcataacatatcccccttttctgataaaggatatccaggtcctccagcttctgttacgcggtctggttaacccagtttccttttttcagtttctggatctcttgccgcaacgatggctgctgctctccggtatcttccacagcagtctgctcattgccggcagacactgtggttggattgcttatgatgactgccgcacatatcacatagaatatagcctgttttaaatctgtctctttttcatcctctgttctcctttgacttatccggaatcacataatttaccaactcagtataccatacctgttccttctgagtaaagtatgcagttagggcgtcatgctttgattattttattaaatgcagtgggttcctcaatctggaatacagcggaataggtagtaatcaaacagagtaagaatggttggggcgcagaaggaaatcatcaacaaaatgttacagaccatctggtccaacagacaagtccaggtaacattagattctacagaagcaaacagaaatataacctagttataccagtaagagatggttgtcaccataaatgaagaacaaaaccaacggtaagcgtcactagttattactgttgcttttctgttttaagtcaatcctatttttcggactgcttcatactttaaatgtcgccgcttttaataagcagaggcccggaattcagccaacgcaaaaaaatgcctcccaaacagtagcgatacctgggaaaatctttttatgtctatgtgaacaaatttcaaccgatactgctttttttgacgggtggttaatctatgtatatgctgaataatccacaatgttgtttttctgaaattataaggggtggaaggaggagactttagagtgattctgggaaaaaccgggaagaaagcttaaattttcatgtaaaataaaaaagcccaatcgaaattgagtatttgggagtagtggtgcatataatattgtaaagcaacttattgatttttgctttacaatatgttaaactaattatgaaaaaggaggtggcatttatggcacaaacaatggttaatttccgtatggacgaagatttaaaaaaaggaatggaacaggcttgtaaagaaatggggctttcaatgacaactgcttttaccatgttcgcagccaaagttagtcgtgaaaaaagaataccgttcgaggtttcagttgacccgttctattctgaaagtaatatgaattatttgcgctctattgtggctgatatagaatctgggaaggctaaactggtagaacacgatttgatagaggattgagtgtatgaaattactttgggaagaaaaagcgtgggaagaatactgcgagtggcaaaacgaggataagaaaacactcaagcgaattaattctataattaaagatatacaaagaggaaccttcgacggtattggtaagcccgaaccacttaaagacaaccttagaggctggtggagcagacgaattgacgaaacaaatagaattgtctattgtgagaaagaaaatgcgattattattgcgtcttgcaagggacattataatgattaacaagaacagtggcaagcactttgcgaggcatccctaccgcccttttttgcaagagttaaaacagaatccacagtctcgtcaaccacccatgactaaagctatatctttataagccaaaaaccctgggagactcatctcccagggccaaggcatctatttctcacgccctgaaaaacacccattttcaggccgcaaatccactcaattttccctcaaaaaccactatatcttgtggttttatccttcatttttctccaaaaccacaatttgacatctaaactaccgtagcttaatgtggtactgcggtggaatagatgccaatccagaaatactgagcctacaattccaccaatggtcgatttcatatactgttgcaatgttttcatcctatgaaatcgctgcatcatatcctgctaaaatcattttagcctttcgtacaaaaccgcatattgcatggaacaattatagtagttcagcaaaaattcaatttactctccatcatcacattcgataaaatataaaaaccagcaaattgccagtaggtcggccgcccctcccggggataggttcttacttataaactgatgatccaaatctcttattattgccgcagccggatatttctccttattgagaatttcattcagctgctttttcacatctatatatgtgggataatcagatcttgcaatgatattcgtatcaaccgcttccgacaataagtagagaagcgtaatgcttcccgcttcatcctttgtatagccttctgccaacgcctttttcaatattggaagacctgtattgagaacggtgggaaatccatccgccgcttctcctctgacaccctttattccatatttcttataaagctgacatcctgctgttggccgttgctgctctatatggttaaaaacaaactctgcatatgtcttcgacagggcaccgcattcccccaaaatctgttctgctgtaagttttcccccgtttccttttagccttccaatcgcgccgcaaatgatgcctattgagaaaatagctcctttatgggtattcacattttgggtttcattgaacattgcactttcagcattcattccttcatactgcaatttccgaaatgttttctcaggtgtttccatcgtggtttcaatgccgattcggatcattgatttgaaatgcggaataagagctaccgaactatcgacaaaggaataaaaatccatgtcatgatgcgagccgttattaaaacgatccaccaatcctggttttggtgatacagaaacttcgtaaagcagcgccttaattgcgaaactcgctatcttctctataaaattatcaaaaaagtattcttccatcatctgaaacgttttcttctgaagttcctctgccggatggactctgcgggaagagcaccgatgaacgggaccaccgcaaatcaaacacctgcgttcactcaaccccactactccccgttccatctttattccgtcatgagccaaaacatcaatatcaaaaagtcttcccagcggatgcgtgtcttctatttctgacatgatacattttatttctatattatcgcaatccacaacaataaaagcttcatttcccgtagcctcatgtatcttttcaaaaaaaagaactgcaatacctctaactcttaactgattaaaaatgcatgttactccttcttcgaaggttttctgaatcaaatcagaatttttcaccggccccgcaatattcaaagtaaaacagattacgtttttttcatatttccgtattaattcctgctggcggaatgctcttgcttccctcgctgccatcatgtctgtaacctgtacttttctgatttccatcttcacacctctttataatcagtagtgtatgacgtcctgcgccttttgtattgcttccaataccggacgcgcctcctctgagtaaagatattcccatgttgttttcggaacaaatggacaaacgctttccagctgtccatcgtgaatccactgtctcactttactggcgctgattacttccccatttatctttttccgcggaatttcttctgctttaatgcccaccttattcaactgttccagcattacacgattgtacatagatgttaccatacttttcttttcttctcccacaaatcgattcgtaatgccaagttctctggcaattatttcaaatattgcaatgtccagttttgcatgagcctcacatacaactgcctcttctttaagaaaataactgggaaacgttccctgtgaaatcatatacggtccgcttgcatgacaaatcacatttttcagatgcgcagttcccttttttaccaggtcctgtcggacagaaaatggaaacatgctgcagtcttcacttaccacaaaaacaagaaggatttcacacttttttgccgcctcctcaacaagaaacaggtgccccattgtaaatggattggcgttcatgactaccgctccgacctgctttcccaaaaactcaacatcatgactctctcgtttcaaactgtttaaataattgggaaatccatttttcctgttctccaaaaaggtaatcatcccatctacatttgcaatttcataaaaccccagatcctgaaagaaacgggcctccctcattttcgtataaataaacagatgcgtatttcccctggatatctgatactctgtcaaatgccggatcaacagattcaaaagccctctcccttgatagcgatgatccaccgccatacagcggagagtatttccaaagcagcttcccgtggccaccggatttccaatatcatctaagatgacacatgtataatccagattgccatccctttgaattccttcctgttccaggagccgagtcactgcaagattcattttactgtctttttcagaaataccctccaccatataatccatttctatttcacctctcgcacaacatccataatggttccgtcgcggccctcaataatacctacgattcgttcaccaaacttaaccggctgcggagtgcctacgatatcatacgcgatatcccttaattcttcaattgtcctcagaggaacacaatcggcattctttaacgcctccaacaaatcctgtctggccggattgactgccactccataatcggttactaccacatcaatgctttctcccggggttgtcactgttgtcacatccgtacagattgcaggaatccttccctgaaggagcggacatatcacgatcgtacattttgcgccctgggcggcatcaggatgtcccccctgggcgcctgtaatgattccatctgaaccaactaccacattacagttgaaatgtgtgtcaacttccaatgccgccaataccacatagtccaatttgttgacgaaagagcctttgttaaagggattggcgtaagcgcctgcactgattctgtgatgattcggatgttttacggaattaacggcaaacaagtcaaagtcctgcgtatcaagtaattttcctacaagacctttatccagcatatcgaccattcctttgctcataccgcccacagcaaatcccatcttaatcccacgttcctccataatcttggcaagcaatgcagcagaagcaatggacgctcctccaactccggtctgataagaaaatccttctttaaaatatggcgtattaattacgacctgggtgcagtaatctgccatcataagttttctggtatccgttgttggctttgccgcccctgtcgcaatcttttccggaatgcctattgcatccaccacacacacataatccacccttgtcatggcaacatccgccggaaaattgggaaagggaacaagacagtccgtaaccgcaaccactttatttgcatgctgtccatcaacaaaggaatacgataacacaccgcagtcgctctttcctccaatgcctttgcagttaccgtaatcatcacatgtcggcgctccgataaatgatatatctatgattgtctccccactctggattgcccgcacacggcctccgtgcgaacgcatgattgcaggctttttcagttttccatgtgagatggcctctccgatttttcctctgactcctgatgattcgattccggtaattgtcccatcctcgatatattccagtaatggatcatgtgcttttccaagagagcttgcacaaattgttacatccttgatcccaatatcatggacttccttcataaccatgttgactacgagatctccttctctgaaatgatgatgaaatccaagtgtcataccatcatgagccccgcatttttcaagcgcttcccgaatggaagataccattttacttgtattgtgatccatgacaggttttacaatcggtccctgttttctgtactcaacaccttctttatagttgttgccctgaaacggttcctttcccgtcaatttgagaatttcatccggaatttcacgtcctactgcatttaacatctcaaaattcctccttcaaaactcctgacgcttttgccagttcaatggtccgctttgctccgtcataaaaggcaatatctatcatttttccatccactgtaaaaacaccgattcccagcttctttttttcttctatttcttttactactttctgtgaaaaaacaatctccttttgtgtcggtgtatatatttcatgaaccggagcaatctgccgcgggttaatgatggattttccgtcaaatcccatcaaatggattgtttctacatcctttttgaaaccttccatatcgtccagatcggtatacacagtatcaaaacattgtacacctgcggcccgggctgctataatcatgtgctgccttgctcccataagttccacccctgtacctgtaattcttgtctgaagatcttttgtgtaatctcctccggaaagagcaattccaaatagacgttcggaagcattgcagatatccagcgcgtttaacacaccttttgccgattctaaagccgccataatcaaaacttttcctcgctcgattccaaattcgttttcagcctcttccaccgccttttctacccgtctcacatcctctgcagtctctgttttcggaatgcggataccatctgcacccccggctactccacaccggatatcctctttccagagctctgaatcaagaccattgattcttacgatacactcgatgcccctgtaattaatctcccgcagggcatggtacaaagaaaaacgggctgcgtctttttctttttccgccacagcatcctcaaggtcaagcatgatactgtccggcttataaatatatggatccttaatcagtcctggtttctgcgcatttaaaaacatcattgttcttctgagtctttttttatttggattcattatcgaaccgcacctccccatggcacatctgttttctgtccggcgcttctgtacacagcgcactccacacgtgccttaattgtacaatctaatgctcctttgtccacaatactgataaatacatctttcacatccaggcgctccaacgtctccctgaccactttctgtatctgctctccgaactgattcataaccacactttcaagctccaattccacgctgccgttacccggttcaaccgtcaccatacaatcgctggactcgagcgttccggcaattgccgctttgtcaatcttcatcttttcaccttctttttaactttaataaaacaacccgccaagattaaacacaccaagcgaagaaagaattacatttaaaagtacatttcctaccgagagaaggaacagcgtccgaaacatcttgttcagttcagccgtactggtttctcttgccgcagaataagatgacataataattgcacctccggtagataaagggctgattgccgctgcaaatgatgtagctgttattgctgaaatcagttccacgtaattgacgccgcttccaaacttttcgcacacctctgccgcaattggatataaagtcggcataacaactcccgttgtagaactgacccaggacaagattcccgaggtggccgccagtatcggaaccgctgtcttttcaatcataaatcctgtcaggaaatcggaaaccaaggtaataccgcccagtgtatcaatcacattaatcaggacaccaactccacatataaacacaagcgtcccccacggaattccttttattgctttcttttcatcaacaacaccaagaagaactaaaacagcagctgtggcaaatgcaaacaaacctgtgtcaagcttaaatccgatacagcatacaaccattacaacgattgccgcgatcgtaagcagctgatcccgattaaactttggaatgtctgaaagcttcagcggattgtccgcttttactttataacctttatacagtatgtatacaacaagtgtaaacaagaaccctgaaagcagtgttgacaaaaacagatgaaggccaaatccactgtaacccagaggctccgaaagatttttagctaaaacacccgtcaaagaaagaaccgatgcacatccggcattcgcccccagttttgcataaagagacgttgccataggattgatatccatttcaaaggccagatacatagcaaatgttgtcatcaaaatgcctgccgcaatatgccccggaccgattgctgaaatgaatgccgacaaaaaaaacatcagaatcggaataaggattgtccgttttcctacaagtgcaaccaccttcttagaaaacagatccaatgttccattattggatgccataccaaacaggaacgtaacacccaccaaagtcacaaacatggaactgctgaatcctcccacaatctcttttgccgacatgcctccaaatgttccgagcgcaaatgcaacaccaatagaaaggaatcccagatttacttttcttataaaacctattgccactaccactacaagcacaataagcgaaataattgaaagactcataatatttcctccacacattttaaatagcgattcttgttccggctaaaaccgtactcttgctaccccttccataatcagattcgcagtgcgaaatccaaacgtatctttgatttcaggaatcttattatgctgctgaaagtcaaccccgcattctaatataccaccgggatgtccaattcgtatatactgcgtatccatatgttctgaacacacctgattcactatgctgccgggaaccactgccgctgctgcagtacacatggcacccgtcatggcatagctgggatgtgctttctgcatagacatcattctggagaccaaatcaatactttcctgtgtcacagtctctccatccatggtcctatactctttgggctgagctacaaatgccattttgggaattccaggagtctcccaggcggatttctggtaatcgtcaatcaatcccagcttcactgccgcaagtccccgaatcttttccaataaagcaagtacttcatcatctgcattcacagcatccggaagttcctttcccgtaagtcctatgtcctccgccttcacaaacacaagagggtttgccgcatcaataatggaaacttctacatttcccagtcccggaacttccagtacatcaactgcatttcctgtgggcaacaatccctttcccaatgttcccgccggatctacaaatttgagttttaccggtgaagccttacccggcactcctgctatactaaaatcgccctcatataccacatttccatctgaggtcttgatatcagcaacaatcagcttatccgtattcgtattatatattctgactgatgttttatcattttgtactttaatcaagcctttttcaatggcaaacggtccaacacccgatgaaatattaccgcaatttcctttgtagcttacgattggtttatccacagatacctgtgcaaatgtataatttacatctgcgtcaggtctgggagaaggacttacaatggccaccttactcgtcacggactgtccgccgcccagtccgtctatctggttcttatccggacttcccatcattctgagcagtacatcatcccatttttcgcgatcatccggaagatcactctccaaaatataaacccctttgcttgttccgccccgcataatagttaccggaacatggaatagccctgtttctttatttaacatcagattccctcctgctgttactgaacagaattatgtttgcgattgtaatttatcaaagaaccacagcggataatttctttttcttcctctgtcagcggctcaattgccagtgataattttcttgttttatcgccaataataaatgccgtaatttccttcatgtcggtgttaagcgcttttttaatatcaggtacaaatatataatcatcctctgaaaaatcggcaggaccattcaaaataaagggtaccattccccaattaatcaaattcgagcgatatcgctttgtcgcatattctactgagatattcgctccgccaagaagcactctctggcaggacgccgcctgttcacgtgccgaaccgtctcccggctttaccgcatatattgtacttgaaagatcaattgactcatcctctactttttcatatcccgggatcgtatgtattttatcaagaatttctctgatttcttcaggacaattcccctcttttcttgccttttcgttattcatcaccgcttttgctttccctacatactccggcacccgtctgcttaatgtaaactcagccagccccataggattggagcggaatgaaccggtttctccggacgggataagttcatccgttgttgttacaggatccgtgatatacgcgcatacctttagaagcatattctcattcaactccggaagctcgggccaggccttaatattgggaccacagataagttcctcttccgaattaccctttccaaacccctgataaactctgttcgcatatactttggaatcataatgatactcaggacactcataaacatatcccaattcatccgccgctgtgattcttccccggttggctgaagttgccgcaacagaacgcgcatccatcaaggctacacttgcaatctgtccattacccggcttagatccctcacgattagggaagtttcttgtcgtatgtcgaaccgcaaactgtccatgcgccggtgtatctcccgcaccaaagcacggcccgcaaaatgcagtgcgaattgtcgctccggcagcagccaatgtctcaattgctcctttctttaagagatccatcataactgcctgagagcttggatagacactcaaattaaacgcatcattccctgtggatttattttccagcagataagcagcctccataatgttcgaatacgttcctccagaacagcctgctattgttccttgatctgcatacaaagctccatcatggattttccctctaaggttcaactgcaaatccggatttttaattaattttttcgcattttcttccacttcgtgaagaatgtcatccagattttcatttaatacacgaatttcatatccatttgaaggatggaacggcaatgcaatcatgctgtgtatggcagacagatcgatgtaaatgcatccttcatagtatgcaatcttttggggctcaagttttttatactcgctgcctcttccatgagcagccaaatactttttcgtatcttcatcggttctccagattgaggaaagacaggtagtttccgtagtcattacgtcaataccatttctgtaatccgtactcattgacgaaacacccggtccaacaaattccatcaccttattcttcacatatccattcttaaaaactgctgtaacaatcgcaatcgcaatatcctgcgggccgactcccaggttgggctttccgtctaaatatacagcaatgacttccggatactttatatcccatgtctcttccaaaatctgctttactagttcccctccgccttctccaacagccatcgttccaagcgctccataacgtgtatgtgaatcagagccgagaatcatcttgccacatcccgcttccgtctcccgcatatattgatgaatcacacccatatgcggcggaaggtaaattccgccatatttttttgcggcagttaatccaaacacatgatcatcttcattaatcgtacctcccactgcacacaaactgttatggcagcaagtcaaaacataaggaaccggaaaccgctccatccctgatgcacgcgctgtctggataatccccacataagtcagatcatggctggtaattgcatcaaaccgaattttcaaattctctttatttgttccggtgttgtgctcctgtaggataccataggaaattgtaccttctttatactgttcctttttttccaaaaattctcttccggcatcattttcttcaacaatcgtttcaccctccagaaggaacacacccgaatcatataatttcattcttctctatcctttcactgataatgaattcagactggccagatctgttttctatatccatattgtatatctctaaatacaatgtgtaaaattcatattttttatttatttcattcattaaagctatgtttatatctatttttcacatgattaaactcgattttttgttgattttttctaatttccttctgatattcacttaatatcctaatttactaaatatacatatttttcataaaaactatagtttataactatttcttgtcaacacaaaataaaacgattataatcaatatatcgttaaacgttttatatttatctacatattaataaatttacagaaaggaattctttcatggactttcgagaactgaattatgtccttgcaattgaaaaatatcataacattaccaaagctgcggaatctctttatgtgagtcagccgacattaagtaaatttcttgcaaacctggaacacgaccttggccaaaaactttttagaaaacttggaaataagtacatcctgacttttgccggacaaaaatacgtagatacggcaagagaaatccttcttttgaaatcgaatttggacatcgagcttgccgacatcctgaaaaaagatgtaggtgttctcaacgtagcttttccacgcatgcggtgcacctacatgcttccggctacattacctgtatttcaggctgaacaccccaatattaaaataaatgtctttgagggaagttctgacgaaaatgacaaacttttattagaaggaaaagctgaaatcgcattttacagcaagccggaaacgctgaatccattaattgattatgacaccatacgtaaagaagaaatgctcatctgtctctgcaaagatcatccgctcggcaggtatgcacagcccaatccctccagcaggtatccacgattagatccgaaattattgaaaaacgaattgattctccaactgatgcctgaacagagaacacgacagattaccagccgatatttcagcaacataggtctaaactttgaaaatgtcatgacaaccagcagtctgcctgcaatcatggaactggtttccgttggctatggagcctcatttatattcgagacccatctcatgcaccatcattttaccaaatccattgactgctacagtttcggtgaaccccaaaccttatccgactttgttgtagcttccagacacggaagctatcttccctcctatgctcacgattttattaagattgctcgagatctttttaataataacaatttatagatactccgaattatactctagtgccccatcctggatttcaagcggattcgggaatctgctggctggccttgatatgtcgcatatcaggtttcatgaccagccttagcaactacctttttggagattgccttgaccacgagtcttattctaagatgcgcgtctatctctgtcattgatattttcatggctcccagggcgtaatcatttatccaccctcttggcacttgattcgctttttactgctatcgcgcagccattggcatatctcgtgaaacggagtcctcttgcttcaagttctttgtccggttctttcagcataatggttgacaacagggagaggtggatagatctgtcctgcgatatcttaccttaatagagtcagttatcgtaattagggactgcaatttaactggtggttaataatcctcatccaaacattaccttatattgaccccagatatataaaaatccccgggagactcatctcccagggccaaggtttcttaacgtggtgctgcagcggaatagatgtctgcatctacattattttattgatacattggaatactatctatcccttaactatccaatcacctgaacggttatttccccttcttacaatatatctgatgacaatatatcccttatcctgcaattctgcaatcatccttttacagtgcgcaatgaaactcctaactccttttgtaattccttttgtgtgactcttgcattctgcttcataatggtcaacactctttcttcaggagacgttaccttaattccaataatggtgccaatggtgccagcttggattaatgacggctgactgtacatatttatacggaaatccccgtcaaaatccattagctctggttctggaagaaaatgagcattgatgtcctgcaaatcttctggctcgctgctttcgatatagcacgggatattcagattgtactcattggtaacattgacttcctcatcaggcacaaatcgggcatacttgggattcgactcatccatggcgaggaaagtagtcacgattttatgaatatcctgttcccgcagccggttcttgttgccgtcctttacatagcctttgctggcgtctcataaaaataccggtgcgctctgcagtatcttccttttccagcaccaggatgcaggcaggaatccccgtgccatagaacaggttagcaggcagaccgataatgcccttgatatagccccgattaatgttctttttgcgaatgtctgcctcggcgttatcgcggaacagcacaccatgaggtagaatgatcgcagctttgccgttggacttcaaagatttcagaacgtgtagcagccaggcatagtcaccgtttttctccggcggcacgcccagcaccgtttcgctgtatcggctgtacacatcaggaatggtaatgccatccatccaagatttatccgaaaacggtggattaaccacgatataattaaaagctttcagtagttcagggttgtcttcctctttgtactggggtgcagaaaaggtgcttttattgccgacaacaacaccggctcctttgttgtgcagaaccaggttcatgcggcccaaaccggcggtgaagttatccttttgtggaacgggcatccagcggctaccagcataccacccttcaagacaaatctgtcccgatactcagaaaaagagatgcgctccagaaagcgctccatcatataatttctcattaaaatatgtgcatctgcggatttttctttcgacagattgcggattaagtctttcagctgccttgccgttcttatcataacagtacctccaaatattgccttaaagccttttctacatgaaacagttccgcataattcatcagcacacgtaaatttttatctttccgaattacataatgccttaatgcatcctgcaacgtctggatttccatattgcttcggcaacgaattaaatcgcaaatggtacgctccatattgtagacaggcacagtatgtccaaatggcgtttgaagattatcaatgccaatttcatatcgctctggtttaattgtataaactgtaataccatctgccttcaaccgcgacggactatatccccgttttactgtaacggaatagggggacggttccctatccgtcaagtcatgaaaaaacaaagctgtttcatgggaaaagacagcatggctacagcgcagatgaatcaaatacatggcatctgcccaggtatctaccgacacataaacaccatgtgctgcctgatccagtcctttttttctgacaaaatcataaaatatcggcttagaaataccttctgctattacctgtgaggtgagcaacatccctccatgattcaccagcatttgttccaactgtttgaatcttgtcatttaatcacttccttttgtatcactattacactcaaacgtaatacgaaagtaaataatttcatctaaaaaagcatggtcatggtccatcagtggatataagccctgaagctttccgctcctgttatccatgtaaagttatgctgtaatgtgcttcctaaaatgctttcttcagccccttttctttaagtctctttaaaaagtactcccctgaaacactcctcaacctatttacccaacatctttttctgagaaatacaaaaagccccgggagaatcatcttccaaggccaaggcatcttatagtttcctccatcatatctccagccagacagcatttaaaccactgtaacccaatgccattacaatagaaaaagcttacttaacagagaatgacacttctatcacccctacttcatataccgcttaagctcttcataaaaattctctcgcgtaccggccaataatacaaccactagcttatcatcttcttcatagatgcgatacgctatttcataattagtccggttataataaacatcatatccataaataccggttaaatcccccacctttgcagacccacaaaagggattttctgctatgctgcaaagcgcttcctgaaacgcctttttcagccccttttctttaatcttcttaaaatatctttgagcggcactggtatatcgtaattcatacatctattcgccctccgcaccaaaaagattctccatcggaatggctctaccctgctctgcaatgcggtctgcttcttcgattaaatgttccacagcaggccgaatctttctgctctgcgctttaaaccttgccaggagctctgttcccgaatatccctcctcaatcaaatccgcaagaatctgttctgcaaattcattgccatccatacggacgggccgaagaaaaatgcctccattttgcagaatgcattccgcttccccatcaaatccaagcacttcaaaatatttctgtggtatcgtaatctgccgctttgaggatatactaatgattttatgttccatgaccgactcactccttgatgcaattgccatttgattcactcctcctttctatgatattctgtattttccgatttatacctttttcttggtttctttgcttctattttatcacattattaacaattatgtcaacctctcttgacaccgcttccacgatacctgcaagcttcagtgggaaataatctgtaaactataatttgatattgaaagggacgccataaattggttcttccattgtaatatctatatagaaaatatcactgcgaattcccttcttagcatagtatttctccaaatacacggccatttttttataaaactcaaaatcttctgtctctttttgcagatccagtagtccgtacaacctgtaccgcattttatctcttgcgtcttccttcatttccgtttctattatcactcttcagtaatatatagatattgcaattgaagcattattggcagtgtaaccttattatagtatcattgccaatcacccttttttacatcgtatagcatttcatatgattattatataattatttatgccataatcttaaatatgcggatagctgatgccatccgcatattccccattgtatagatgatataattcttaaccaaagtaataccaaatactatgtgcttcatcctttaagagacatcattacctacatgcttaaagtatcaatttcctgcgtcgtagacgtcatagcttcgtccagctgctcttccatccccatcctctgatgcagttccctgcatcgcccaagtactgccttccactgcgtatcacctaaatcttccggttttttcatggccaatacattgtcaaatgatacctccgcatggttcattgccttatacgctgcctgctgtaatgtctcatcctgttccgaagtctgggacggaatatcctcgtcttctgaaaaagcatggtcatggtccatcagtggatataagccctgaagctttccgctcctgttatccatgtaaaatccaaaattggctccatggcggtcttcatttccaagtatataatctgctatctgcattttataataattggctgcatccatctcctttaccctatcatattcatttttatcgtgataactgcaatatacctgaaaatcttcccatggaacaagagcggtttcttcggaagatataatacggcattttactattttttctccgcttttatatattttttctatatgattccggtctgctatcttctccagactgctgttttcagcctcgatatagcttacgtggggaatatgaagcgaatccagtatcccgctggccggcaattccttttttccgactttatacagataaagtccgtccgcctccctgatccaggctttggccgccatcccctgagcagtaaactccggtgtatgaatcttctgtacaagtgtgtggaaggtctggttggtaccaagaagagcggttgatgtgactgctttctcccatggattttcaaacaggcttacctgttcccatgtaaacgtttcttcggcgtctttcatccagtaacaatcagaaagggaagcaaaatgaaataatctggctatcatatatggattactttggctgatacgaaaaccggccaacagctttttagcgttagttctgcctatgttcatggtacgtttctcagtccagccgtgcatgacatcgtcgtagtttacatccggataacgcagcgagatgggaagtaactcatagttcagaatcttacatctgtaatcctctatttctaatacagggacgtcttttagcatgatatatgttttattcattgccgctcacctctcttctctcggatatggaataatcattatgtgggttttattatatcattatttttatgcattatctatttctttattgagacaaatgcttcttctaatcgacattatttcaagttatacattctttttttcacattgcgtcatggggatgacttacttccgctttttctatcaaacccttatttctgaagcaccagatgccatgacacctgctcctctttcagcttcatggctgaagagtaatcttttaaggcctcaggaaattgccggaccggatagaaaatctccctgtctgcaaaaaaagcacacggtcctattattcttaatccacagcagaaaaacttccacaacaagaaatcaaacaaatagacaaaaatgcctgacattcaccgtcatatgacacgattggtctgtcaggcttttatttttcctggaaagaagataactcacagatgctcccacacctcctcatgagtcaccgcacaataaaaggctgtcccggttcggtgccggaggtcggtgccagttctctaaactggatatctttttcactggaagccaccgttctctccatacattttatacccataatatcccctgtcactaacctcccccctattattacatatatcaattataaacttcccctgcggtacagctgattttcttccggtttaagacaatcactgccattgcacagaaaatgggaatcagcatgattctccacatactcacatatcccatatgccccgcagccactcctgcaacaatgggacccaacaaaaaaccgaaatccgttcccaggtaattggtgcagctggcagcccctctcctgtccggagttaccatcttcatacacagagcttggagtacgggtgtgcatgccccatatccaaaggctgagaccacagcagccagataaaacatccacaaggtggtggaacagctgatgataataaatgacagtccgaaaaagcacatagccggaacaagtatctttacagttccaacccggtcagtcagcctgcctacaagaggccgggtaaacaaaagtgtcagggcataaatggtaaagaacaggccaattccgctgcctgtgattccctggtcctctgcaaaaatatagaggaatgtgttaatgaggcaatatgcaaatgcgaggaaaaactgtgcaaacgccggtaccataacctccctggcaaccatactgttcagagatatccgaaactggcgtgtacgtacaaaatctgttcttatctgtatggcacacaaagcccccgccagcataaatactgctgctgcaaaaaatgtagtctgaaaaccaaacatgctctgaaggaattttcctatggtgggtcctatggcctggcacatggcctgagccagggtaaatatcccgataccctgccctagtttatcctttggcagagcatctgtggcaagagccagacagcaggatgtagtaaatgcctgtccgcagccctggagcaggcggaaagcaaagatggaaggtacggtataggataaggcgaaccctaaaaaggcacatcccatcacacacatggcaccgctgagcagatatttccggttaaatgtatcaatggccggagcagaaaaaaccttcagcagaatggatgtgatcgtgaatgcactggctatgagtccaatgatcccctccacagcccccagctcctttgcataggaagttataagcggctgaaccatctgctgtcccacatacataaggctattagtaataaatacactgataaaagtaatgttccaaatacgtggtacattagaagctttagggattgttatttccattttggttattccttcctgcattttataacagcctgcgctaagagacgtacttaaggattcaagtctgtcaagatacaccacatcctaagtctgaagcttaaagcagactgctgtcataaacaacacaaacattattgaaatagtgcatacggatatgcggattaccggccttggctttaaatatggtctcaccgggcgggtcctgttccgttttccccattgctgtctcttcacaggcagcggccaggttccctgctatatgtacaggcaggaccacaggcaggtgggccggataaaggactgtatctttgcccacacaattcataaattcatacagctggtcccggtactgtaaaagcccctgccggtccagttttttcaggcttacatccatattaatgccatctcctgtaaacacatagttctcctgccggctataaaacatatgatggcccggggaatgaccaggaaaagaaatggcctctatcactacaccgcccaagtcaaatatctgaccttgttccaagttctggaatctggtatcgctgttatcaatataatgttcctggcagtaagcaagaacctctggtgaatccagggcaaagcccttcaaatcctccaggcgctggccggtattcagggcaaaagaggacaacctgggataatcccggctgttcagatacgcctcatcgaacaaaagcgcgctcccaacatggtccggatgtccgtgggtgcaggcgcagataagtggcttacctgttcccacaatacgttctatataatctctaaggccgggcgcaacaccaagtccggcatctatcaccagcactttctcatctcccaccaccactcctatggtgaaacgatggaccatggaatagccctctgtgacaatataaagatgttctgattttctttcatgactccagaagcatagattctccataccctacctccgtgtgaataaaagattgccgggcagacacgcctttgtcctttccccgctgtcagtcagccgtccgtctctgcctatagtgaatctggttatctcatctgaatcccggttagatacaaacaaaaaccggctgtccggcgataatgaaatcccacgcgggttctttcccccacaggaaatattctgtatcagacacggattccccttgctgtccagctcaaggacagcaagcaggttggctgttctgacagatgcatacagataccgaccgtcaggggaaaccgccaggtctgcgggtccttccccacaccagtgcccggccgcctcctcatcctccagaaggcatacccttgatatgcgttccagttttccgtctgccgtatcatagtgatacaggttcaggtatacctgttgttcactgttctggtaaaggactggctgggtgggatggaagcagctgtatcttggggcgcttttttcttctgcttttacctcatttaccagtctcagctttccgtctctctcatccagtttaaaggaatataaccgatccagccccttatcgcaaaccacaaacagttctccggttggatccatggttatggaatgaagatgggcattgacatggcgcccgcacctttcctccccccggcatatccacacatcacttatatcacctaaactgccgtccttcatgacgtggaaacataccactgcagcagcatcataaaccacctcggaccggtagtttccatcttccgacctttctaatcttgtggcgtatccgtctgacacatgatgaaccaccagcagataattgtttgttctgtccaagcacaaataggagggctgcggtaccagggtagacctgcggctgattacatggggcataccgctgtcagggtcaatcctcaccgccagtacttcccctcctttaccctccattccatctctgtccctgcattcatttgtgatataatggacgttgtcaaaaggaccgggacattgctggcccatattaatatcttccaagcagcggccaatatattgaaatcctccgttttccaagtcataacggtatatggtcaggcctttttgcagcccgggtttcatagcaaaactgccggacagagcatatatgttttctgacattatctctcctccaatttatattccgcacgcacgaactccagtatcagctgttccaattccccatcaattccctgatgtccactgcaggtatcgcccaattccatatatccataatcagcgccggattccggccaccagggcagtccctcctcattcggattccctgtttttataaaattagcccagtatgtactgataatatcggccagccggtaatcaatctccctccatggacggtgaggcggaattccttcccttaaggaagcaaaggtaaaccatagttctgtagaatgccatgccagtgtatttgccgggtccagaggcgttcccttgtcctcttgcggacagggcagctgatgggtccaaagataactgtagcaatgattcctgggatgtctctcccgcatatacatgccaaagtaccggttgagcatcagattcctgctgacattcattccctcgcttccgcacaacccacggtttgccagaaatctcgccatatcccaggcattctcatccgtgacttttaccagattaccaaaatcgtatttatcatacagcgttcccagaaggttcctgaagtgagcataaaaatccatggagctgcgtataccgttaataaactttcttacaggcacttcatttaatccggagactgattcagcaaacacctctgcttctccgtcatctgccccattgataaagtccacattctccagcccatgttcaaacagctccctgacgctcctgtaaggaatcaggtcgctgtcatataccatatccccgggcagcaatacccttggtgcgtctttataaagagtatgtgtatccatatttctaagctcttccaccgaaatatccgggtcaatccctgcatatctcagataccgctttcccagttcctcctgacttttaaggcttttaaaaggaatcatccacttattgccgctctggttgattacccgttttatcctgcctcttgaagcaggcgatgcagccatcacgcaacacttcaaggcaccgcctgactgtcctcctgctgtaatattatcaggatccccgccaaatgcactgatattctcgctgacccagtccagggccttaaactggtccatcagcccatagttaccgctggttccctgctctcttgtaagctggggaagacaaagatatccaaacagattgagcctctgccctactgtcaccacaacgattcccttttttgccagttcctgagggttaaactgcacttcataagaataacagttggtcaatccccctccgtgaaaccacatgaatacaggacgcctttctcccggcttggatgcaccggtacacacattcacatacaaacaatcttcactcatctcaggcgaatctgcgaaataatactccctggcatggcggtccgtaagcatggtttggattgcagccggagggaactgcctgcagctgcgcacaccttcccaggaatccggctccctgggtggggcaaaccgcagccttccaaggggcggggcagcatagggaatccctttataaaccgtaattccggaatagattccattgtattccataccctctacttttccgtattttgtatttacaattccaagagccaaatccttacctcctctaatatatatcaaatctccagacccgcctccattttaaggcctgccctggcgttaaagtaaaacagttgacaatctccggggacagtatatggtccacaccccagacattaatctgtcctggaacaaaccagtcttctccttccacaaacgccctggcgcccttgtgttccagtctccatttaaagggaatatcctgggcaatggaagtcgtgtctactgataaatcagtgtcaatcgcagtaaactcacaaaatgtaaaaccgtgtttacatccacgcagggaaccggaataccctctcctgttattgatacgtccctgtccctggtccgggattgccggcatggtcaggacataatccgagcccacagccataccatcaatactgaggaaattatggcagaactcctgtatatggatatttttgcttccggcattcacacactccacatccatagtaatctcattgccgttaaccgctatattcttcactgtcctcatggcatatcccagacagggttccggctctgtaacataggttgcggaatctgtggtatgtgacagctttatttcatagggacgcacatccttatatgccctgtaaaacagatatcctttactgtcttctttgcggatcagtcccactccgaactttggaaaatattcccccactcccgcttcgctgcttacatcaaagcggtactcattgcaaagcccccttcctcccgaggatggatgcaccaggtttctgggttcggatgcgcaaaaatgcattcctccatccagaaccacctctgcaatatatccggcccggtcaaacctgcaggagtcattaggtctctcccccggctctggcagttcaaccctgagccggcccgtttccaatgtaatcattccaaacctccttcagccaattccgtcatctgtataagccagagcccccaggcctttaacagatttatattttgtaatccgccctttgcgcattacctgataatcaaagcaatcaggattgccaatgaccgcgtcacatgcttccagcatattccccaccacggtattgccaatatcaacaataaaatgaccgggaaacaatgaatcaaattcactggttcggcctgacagccgtttaaggtttttactgaactcacggaccgtggcgtattcaccataaggcattccgggcttaggtcctccaatcatgacccacatgctgaggaatgcatccccacaaaaaagaatgcggctttttttgtccaggaatccggcatgtcctgcatcatgtccacccaaaaatatcagttccacctggtaatccccgcccagacagaagcaatatccgtccgggcatccggcaatctggtattcccggtaaggtatgatatcactgggatcaaactccagccatatgggatttcccttcccgtcaaagaggaaatcccatacattgggattcatcatctgttccagatagggcactgcatactcatggcagtacacagtatcaaactgataattgccataagcgtggtccctgtgggaatgggtattgactacaatcaggggcatacctccggtaatggtttctgccagccccttaaggttcccaataccgaatcccgtatctatcagcatagccttttcaggcccaagaatcagatagctccaaggagctccgccaccatctgcattgtccgtataaatcccatatacgtgctcccgaaaccggtacacctccgcataagggtttatctcctcatacaccatcctggtattgttatgggatcttagctccttcatataggcagcactcagttcctctatgggttctgcctggatgattctggatttcatgcgcataaccccgcatcaggacacccttgccctgtctcttctgcccgtgcagatgtttgggaatattccagctccctcgccctctgccgactctcccgccagtacgggcatgcaacataatgtccatcctccacttcctcaagttttggtgtttccctgctgcattgttcacacgccatgaaacatcggggcgcaaatctgcatcccggtttgggattcatggggcttggcacatctccgctcagcacaatgcgctgtttctgttcctcaaactccacctttggaacagcggaaagcaaagcaagagtgtatggatgcattgtattttcaaatattctgtccgtgggagccatctccacaatctgccccagatacattaccgcaatccttgaggatatatgccgaaccacgcttaagtcatgggacacaaataagtaggtcagccccattttcttctgcatgtccatcaaaagattgataatagtagcctgtacagatacatccagggcagatactggttcatcgcacacaataaacctgggatttagggaaagggcccttgcaatgcctaccatctggcgttttccaccgtccagctcatgaggaaatttatccaggacgtatttttccagtcccaccatatccgccagttcttccaccttctgacccaactcctcttttttaacgatattatgtattttcaaaggtgtttccagaatgcttctgattgtctttttgggattaagcgaagagtatgggtcctggaacaccatttgaatttccctgcgtatctcctccatcttccccctttttgcagtaactatatcctgaccaccaaaatacgcatgtcccgaggtagcatccaacagcctggtaagtacattacctaccgtgcttttaccgcagccgctttccccaacaagccccaacgtctcatatggcatgatttccagagaaatatcatccactgcatgaagttctcctttgcctggcacatcaaagtatttcttcagatgttcaatttttatcaggggttctgtacctgacttgttctccaatccgttcatccttctccctccatattccagcatgccgcatagtggtccccttcaaccctggtaagaggcggtttttccagcctgcattgttccgtgcaacgcgcacagcgcggatggaacttacacccatcgggaaggtcctgggcatttgccaccgcaccagggatagaagccagtctttccctgtctccggtcagcttggggattgcattcaacagccccatcagataccagtgcctgggattcttaaacacctccctgaccggcccatactccacaatctcacctccgtacataattgctaccttctggcacaactccgctatgattcccaaattatgggttatcatcagcagggaagtattatactgcttctgcagattcttcatcagctccaggatctgggcctggattgttacatccaatgctgtagtcggctcatcgcagattaaaagttcgggtgaacatgccagggccgccgctattcccactctctgccgcataccacctgaaaactggtggggataatcatttaaacggtattctgcaatccctacctggcggattagctttgccgcctcctcatgggcctgtttcctggtcagcttctgatgctttaacagcggcatttcaatctgatgacccactgtgaatacaggattcagggaactaagaggattctggaaaaccatggcaatccgtttgccccgtatcgtctgcatcttcttatccttcatcttaaggagggactgcccgccaaggctgatatccccttctgtcacatagcccacatggtccggcagcaggttcagaatggaaagggctgtggttgtctttccagcgccgctctcccccaccagccccagggcctcccccttgtgtatggtcaggctcaaaccattgactgctttggccacagtgccgccagaccgatattccacatgcagattatcaatctttaataattcttccatcatatttctcactttcttccggtcagtctttgtttttagggtccagtatatcccggacaccgtctccgaaaaagttaaatgacagcacggtcagcatcaggacgattcccggcacaatcacaatccatggcgctgtgctgatgtactcacggccgtcagacagcatggttccccaggccggggtaggaaggggcacccccattcccagatagctcatgctggcctccgtaaggattaccacacccagattctgggttgcggaaataatgacctgtgtcagtgtattaggaagcacttcggatgccataatccaggcattgctggcccccatcagttttgcagcattgacataatcagaactgcgaattgtcagtaccacgcctcgcaccaccctggcaatcataacccagttggtaagtataagcaccaatatcagattggaatagtcacttcccagcactgccaccacgcatactgccaacagcagggccggcgtcgccatcatgatatcgcagaatctcataatgattgtatctgcaatgccaccgtaatatcctgccatcagccccagtaccacccccataatggtgctgaagattaccacggaaaaagagatgagcagcgatgcccttccgccaatcagcaccctggtaagcacatcccttcccaatgaatccgtgccaaagatatgaccagtccatccattggccaaccactccgggggcattaagcgggaggtcaggtctgcttccagaggattatatgccacatagataggagccaggacacagagcaggataattgccagaattccggttcctcctatgagaaacatcttatttttacgcatcttccttaaaaggctttttctatccatcttttctgtctccttttagctgaacttcacacgtttatcaatgaacgtgtaaaggatatccacaatcaggttacaaagtacaaatacaaaggctgagaacagaaggctggactgtaccagctggaaatcccttgcattgattgcggtgatggtcagctgtcccatgcccggccagccaaataatgattcaatgaccatggagccagccagcatggaccccacctggcttccaataacagtaaccaccggaagcagggcatttttaaacgcatatttcacattgatttcatgccttccaactcctcttgccctggtggctgttatgtaatcttcctgaagcacatccaccatcccagaccgggtcatcctggtggccagggatgaaaactggaacgccagacagatagccggcatgatgatattcttaatcccatccgacccctgggtaggcagccacctcagcgtcactccaaacagcaggataagcagaagtcccagccacaccggggacagtgactgccccagcaaagcccagaaagttgcaaagacatccacaccggttcctttctttacacccgcgattacgcccaatggaatggaaaacaacaacgaaaacagcatggcacaccctgccagcttggccgtgtagggcagccggttcatgattaaagtagataccggcatcttatagttatatgaataccccaaatccccggtaaggattcccttcatatatgtaaggtattgttccacgtatggtctgtccagccccatcttgactctttgggcctgtacctgagcttcggttgctgtctcggaaagcattaaacgggccggatcaccgccaccaaggcgtaccaatgcaaatgccatgatactaaccccaatgaggacaaccaccgtagatacaaaccgctttgttatatttttaagcattttcctgctcccttcagatattcaaacctttagtttttcgtaacatacctcaaatccaggatattgtctccaaatatggtcaggttatccagattgctgaccatagccgtacagtttcccacctgatacagatagatatttggggcaaaattgtccattacatgctggaatatctctgtggcattctttacacgggcatcactgtcaaccagtaccattccctcttcgcccaatgccttcagttcatcattctggtatccggtagagaaacggtctgtcgcgtttacttctatggccggtatataaaattcgccggaagtaaatgtattggtacagatacaaatatcataattgccggctgcacggcgctcattataagttgcattctccaatgtctcaatacttacattaaaaccagcctctgttgccattgactgtatggcctgagccacctcagaaccacgcgtcagtttggcgctgttcatcagaaggctcacttcctccccctgataacctgaacctgcaatcagctgtttggcacgttccaggtcatacacatatccctggtccctgtaagtggcatgtccttcaaaggaaggccatgtagcaatctctcccccacccaggatactgtctactatcagctgacgattaatacaaagagagagcgcttcccgcagctcctgattattgaaaaccttgccttctccacatccgattcccataaagaccagcatattggaatggtagctgtctgctgtaaagccctctcctgtcaggacttcaatgttatccagagggatattatcacagatgtccagttccccggcccttaggctggatactctggtggtgtcctcacttacatatttatatttcagcctgtccacatttgatttgttttcatccgtccagccccaccagctgtcattcctggtcatctccacctgcccggtggtagcgtcataagcagccaccttaaatggacctgttcctaccggtgcatcaaaataatgctccgggtctgcgtcataggcgtctgcgtttataataggcagaagggataactctgaatacaaggtgggcattttattggaaaagtacagcactgccgtgtaatcatccggtgtctccacatgatctacataatctgaccactttgttcctaataccagggaatcgtcttccaaaatacgttcaaatgtccgcttcacatcgtttgacttaagttcttcaccattgtggaacataaccccctcccgcagcttaaaaacacatgacatactgtcatcagccagttccacatctgttgccagccatggctcataattacccatatggtccgcatccatcaatgcatctccccataaaaggcccagtgtaaaatccgccgtatcatattgattaaagcgatccagtgtctcaacaggttggtttccagcatatgtcagtacaacctcactgcctgacgaatcccctgctcctgctacattacctgctttctgttccttagatgagccaccgcatgctgtcagtatggatgcgcttaacattcctgttgccaggatagcaatacatttcttcgttttctttttcatttctacgtcccttctccttttgattcattatagtgttcaggcattcagtccgtggtccaatgcccctgtctgtgactcaaaattacctcataatcacgctttggtcaattttactttaatttgttcattcacatatctggtgataaaaacaaaaatatgttaataaacccataaaatatgaacaaattcaggtatactctgccttgaaactctaattttatttggatataatcattatatattaacaggaaaggaacggaaccatgaagctgctaaaaaatttcaaattcaaacatcgttttgtcactactctgctcagtcttatcatggtctgtttccttctctgctgttttgcatattattttcttattaatatggtcataacaaaatccagggaaaattcagtgcagatgaatcagtcctacatcaatacagaagcggataataccaatcagctgatttaccagctccatcagtccctgacccagctatcctattcccgcagtatactgaacatggtcttttatacggaatataaggacagcaacaaaaatctggctgcctctgacctggctctgacagtccagaataatcttcttattgattcagccattctatatctgccggaacagcagaaggtcataacctcctcccattgcgtatacccgctacaggattattctgaatattccatgattgcggattatgataatcacgctgtcaatgcagtagcatacgaagataccgaaaaaatcagttcccttttcttctactctggggactttattatggcaagggattttcctttaaacggtcccggaaggctgggtaccctgttttataaggtaaacatcaatgaaatttattcccgccttaccagagaaataaaaagcagcagccatatctgggtatatgatacatacaatcttcctgtgttcgcccatattgtagcctaccctgactttatcaccaggaatgtgattacggcgatggaatcctctggggaaagttaccgcatgataaaaaactcggctctattttacagtacctcaaaactgctgggctggaaattcatctacgaagtggatgaatccgcactgacacccggaggaaatgcattaaatctgatgctggtacccatcatcatcatgataactgcggcgattctgtttatttttctgtttatcacctcaggaatctacctgccaaaacagctgggccggctgctgaagctgacagatggatttaatactccccctgatatggaagaggaaggtttgtcccagaacgagtttgaacatctgaatcaggcgttttcaaggatggccggacaacagactgaattaaaaaccactatcgacgacatttcccctgatattctgtcacgtctgttcctggatttgctgtccggagtccagaaaagccaggaagacacaaaaaaagcattaaccctggctcacagttcctttgaggtcaatgccttttatatggcaggcgttctgtattgtgatggtgatttaaagcagattgaaagcagacgccactatatacaaaaggaattaagcgcactgatggatgtgtacaatcagggacaccactcctgctcccacattcttaccgcggacagccgtacctttgtcatcatcctgtcctttgctcttaccgagtcccttttatatgtcattaaggaggtcagcgaactggaaagcgtcattcataccttgtccaaaaaccaggagatgggcatgcggtttcaaattggccatatttattactctatacttgacattggattttcctaccggaacgcccttgatgcactgcctccacaggaaaccggcacgttaaacacggtttcctgtgatatggtttcccctgatgcgttttcccctgacgcgttttctcccgatacggtctcggtctctcctgatgaacgggccgaacagattcttaatctggtaatgaatcaggatattgacaatgcttacgtactggccagcagaatcatcacacaggtccgtgaatcacaaaacagcctggagcagcagcgtgaacaatataaatcccttatggcctcactctccaaacgaatctcccgcctggaatatgtggatctttccgtgattccaaatgagctgctggtatttgaggataaaatgtataaagatgccgatgaactggcgcaacagataaacactgcattaaacaggaccattgatgaacttcataagatgctgaaaaaacagcagaaccatttcattattgctgcccaggactacataagcacaaactacagtaacccggatttatccctgaattttgtcgctgaggcaatcaatgttaatcccagctatctgagcaagctcttcaaatccagcctgggaatcaatttcacggaatatataagcgattacagagttaaatgcagcatggcgcttctgaaggaaaccaccatgacactaaacgatatttcagtcagctccggatttaactctgtacagaattacatacgtgtatttaagaaatatgccggcatgacacccggacaataccgaaaaaattaagagttctgttttaagctccccaccttacggctcataatgaactttttcccaatgcagcctgtctaaagaatggggagcaggcttagtgacagggattcccagagataggagtgcggacactctgtaatgttctggaagatccagaaacctttttataaagctctctgtatctccccctcccactgcctttctcattctcgcattaatataacagcttccaagtccaatgctgtcagccatcaggtgcatgttggccatggtaatagcacagtcatcaatccagacatcggacttttcctggtctgcaatcactataatggctgccccggctttttgtagcattttaccggctccttctttacaatcggaaagctgcaaaagtttttctttttcccgtattaccacaaattcccacggtctgattttatgacctgattcagataacagacctgcctgaagaacaagcttcattttttcttccgggatttcttctcctgtatagctccttacactccgtctgtttaaaagcatatccaacagtgtgctcatcttaaaaaacctcctctttctgattatatatgatactatttttctgtaaacagaagcctgttcacagcgctgaaaatcccccttatagatgccctggttatattggagctgacacctaccccataggttgcacggccgctttttttatcaagaatatgtatatatgacaccgccttcgcacttgagccagcacttaatgcgtgctcattatagtcaagaaccttgatttcaatttgaagcgtttcttccaagccgcgttttacagcatcaataggtccatttccaattccctgaaagcatttctcaattccatggtccgtaaatgttacctgggcagcggtcgcacatgcatccttctctgtttcagtgtctgtaatctgacatctgcgaaaatgcaccggttccttcctgtccagatagtttctgcgaaactcatccataatctgttccggagccacctcgccctgactttctgaaattttctgaatcatatcggcaaactcccggtccattcctttaggaagcttaaatccataaaaagtttccatgacaaacgatactccgcctttgcctgactggctgttgattctgacaagcggttcatagacgcggccgatatcagatgggtcgataggaagataaggaaccatccagtaatcaccaccctgctttttaagtgcttccatccccttgttaatcgcatcctgatgagaaccggaaaaggcagtgaacaccagctttcccgcatatggatggcgctcatggatattcatttttgtacagtactcataaacctctgcaatttccctgacattttctatctccagctccggattaataccatgggaaaacatattataagccagcgtcatgatatcaacgtttcctgttcgttccccgttcccaaacagcgtgccttcaatccgctgtgccccggctaaaagagctagctctgcagacgcaattccggtcccgcggtcattatgggggtgaacactgaggataatactgtcacgatgattcaaatgccggtccatccattcaatctggtccgcatatatatttggtgttgtcatctctacggtagacggcaggtttattataattggtttctgcggagttgccattccccacgtatcctgaactgccgaacatatatcaagggcaaaatccaattcagtaccggtaaaactctccggtgaatattctaacagcaggttgccgtcaaaacatccggcatacctttttaccatatctgttcctgttgtcgcaatgcccttgatatcttcacggttcatctgaaaaaccacatcccgctgtaaagcagaggtggaattatatatgtggaaaatgacatttttaactccctggattgcctcaaatgttttcctgattaaatgttcgcggcattgtgtcagaacctgaatatacacatcatccggaatcatttccctctctaccagctgacgcaaaaaatcgtattcaatctgcgaagatgccggaaagcctatttcaatttccttaaatcccatcttcaccaacatgttaaaaaaccggattttcttttccacggtcataggttccactaaagcctgattgccatcacgcaaatccacactgcaccaaacgggcgctttctgaatctgtttatctggccattcccgttcctgataaggaaaggccggcctctttttgtatttttgataattcagcataacaactctcctttaccctaatctccataggagttttttaactctgttcttttactcataatactgcttgctccaataatcataacgcatatataaattccaagaaacagagaatcgaagggcagctttaaaaatcttcctgccaacacagctgctggtcctgctgccatggatgctaaaatcccacggctctccacgttacattttacaaacagtgcacaagtcaggggaacaaataccacggttcccctgattcccatggacaggaatccgaaatcattgataattccttcaggcacacataatgcgattatggctgcacttccaagaatgcaaagaatggctgaccttgtaacatgcagctttttctttgcatccgatagtgaagactgaagtctgcaaataatatcattgaccaggatggatgctgcacccatggataatcctgctcctcccgaaactacggttatcaataaagtaccaagaatgattcctcctatcagcggcggagtaaaatgaagaacaaattccggaaacgcctgggcagaacctgcaatgaccatcatcccctccggaattttcctgccggctgctgccaaagcctctgcttcagccgcagtaatacagtgtaccctcatgaatattccaatcagggtacaggatatcccgattggcggaataaagcaggctgtcagtaaagcgcctttccttgcggacctgtcactttttgctgaccagattgcctgtgcataggtctgagtggaaagaacccctagtacaagtgataacccggaaccagcgtcttttaaaatgccccgtgaaaacagattccaatatcttgaattaacatcctgcatggcagacaggccattcatcttccccagctctgtaccggccagccgtgcatatagctgccctgcaagaccgcctgcttcacagtcgcctgcaagcacaataacaagtccaagtgcagcggcggcggaaagaagggtcaattccacaatccctcccattcccgctccccaggtccccccaaacaccacatataccgccatcagagtaatagccagtagcgctgctatccagggttttaaatggagaatggtggttaaaagggcactgcttgagagaacctgggcgattacgctgataaaaataccaatggaacagagaacggaaccaaaatattctgctttcagcccatattttttcccaatcacctcaagaagggttgcgctgccgctatggcgcagcggaaccacatatcccaccgccagaatcagacaccctatacctgagcccagtgtaaaccaccaggccgccatcccgtaacaaaaggccatctgcgcggtgccaatagttgcctgaccactgaccagacatcccagaatagctccgcatacaatccacgagtttgctttaccgcttcctgtatcaaaatcctttgcatctgacacctttctgcctgagcagattcccacgcttataatcagtatgatagtcataaccattcctgataaattccactttcctatactcacaatctatccctgccttatcttttactccacctaaaaatcgcagaaaagcagtcagatatatctacagacaaataatgtctgtgtaataccgtgaccgcttttcacatatacttgtagaaggatattataatgtattaagataacggcctaatgccatagctgcatgaatgccatcacctactgcggctcctatctgggccggtgaaaactgccggatatcgcctgcagcgaacaccccggaaatttcagttgtcatatgctcgttcaccggaacctgtccgttcgggcataaagtcaaactgtcctttaaaaactgtgtgttcggcacaaggccgatgcggatatagattccttcagcatccagacgttttctctcaccggtggccacattcagaatatctacgcctgtcacccagtcttctccagtaatgccctcaatcttttctccacacataactgtaatatccggattttcttctgctctgttcagcagaaccctggatgcctttggccgtgacatcagttccaccaccgtaaccttacaacccagatttgccagcaaaagggcttctgtgattccgctgtctccggctccggcaactaccacaggctttccggcacactgtgcaccgtcacaggtagcgcagtaaaatacacctttatgtgccagctggatttctccgggtacatttaacaatcttggatgggaaccactggctatgataatgcctttgcatgtgtagctgccatctcctgtcttaacaatcttgtagtcacccttatcctggattcctgtaacctctgccatctcgacttcagcgcctgcgtccgcagcctgctcaagcatcgcagagccaagatcaggtcccatgatacccccggcaaatcccgggtaattctcaatcagctggcggctcatcatttcgccacccatggtttccttttccataattacagtttcatatccggcgcggcttgtatagattgcggccgccaatccggcacacccggaaccgataataacgacatcgtaatcagtaaacatagtttcagccccctcgtcttataacggcctgttatactctgctcttgaaggaagttttacaatgaaatccgacttggtatgtaatacgccatcctgattctcgccccatacatggacttctaccacatgatcgttattttcgtccacatactttttggacacttcacccttaacataagtcatatcgccaaagaacaccattcttctgtcctgggaatctgcggacttaacaaacgcatcatcacccatccagtccgtgattccgtgaaccagcatcatctcgttctgaatgcctgctgaatttgcataaggataaccgaaaatattagcggcatggtccgtataatgccaatcacggcgcagtatgtgctctcctgtatccggatcaattgggtgatgctggagatgttcgcgcatgacggcccatttgattgcatatgcgtatggataacagctgaccatggtccgtgcacatgcgtccgccacatcaaccggtcctttaatgatggtaggtatcttttcaccgacctctacctcttcccagtatctggtctttgctccacggcggaacttgccgtccagctggtcatcatagttctggtgaatcatatccagttcttcctgggtatatacgcggcgtaccttatcctgatacatctttgcttctttcacctttttaccgcgcttaccgggcggggttgccatatagatgttacggtgagtctcaactgctacaatctcatccttctgattgatgtaataacgcggtacactttcgataaacatacggtatggctttccttccacctgtttctcctcaaaaccggcatagcggtcataaatagagaaggaatctcccggacggataggcttcaaataatcatgtttgctgccgccggccagccttgcaatccccggaacacgcagacgtccgccaaatgcagatccgaatgcaatacaggactcaaacagcggaggcgcgataataccgccccaacgggtaccagatgcataagttggatctctccagattggattcggatcaccgcaggcatctgcaaaatgacggattaaatcctctgtaatatatttgtagttgatgccacgttcatactcatctgtcatgattgcagtggatggcggcggaagcttcacctctcctcttccctcgttgaacatcgcaatcttctcatccagacgtttgttccattcttcatcgcttaagttatcccagtcaaactcttcattgatattttcagccatcttttatttcttcctttcttaataaaataatatgtactactataactattaacggcccttccattgaggctgccgtttttcaagaaatgcagccactccttcttcccggtcctcgcttccggatacaatggcaaaaaggcggttttcaaattcaagcgcctggtccaggctcatttccagcccaaaatccacggcgtccttagcggctctaagggcaagcggggctttagaagccagtttttttgccagcgccctggtttcttccatcaattcagccgccggaaccacccggttcaccaggccaatcctaagtgcgtggtctgcacggatgatatctccggtcagtaccagttccatagcgtttcccttacccaccagccgggccagccgctgtgtgcctcccagtccgggaataattcccagattgatttccggctgcccaaaacgtgctgtatctgctgcaatacgcaacgtacatgccatggccagctcgcatcctcctccaagggcgaaaccgtttacggctgcaatgcttggctttgacagatgttccaaacggatatagacgttacggcgggcgcggcttttcggccccagctcagtcagtgtatttctagcaccaacctcattgatatctgccccgccaacaaaggctttttctccagcacctgtaagaaccagcacactgacttcttcatctgcatccgcctgttcaattgcatctgcaagttcacccataagcgcctgggtcagtgcattgcgtacttccggccggttgatggtaatcgtagcaattccctcgcttttctcatatataatgaattgatagtccatctgcatatcctcctgtttcgttctgtctatactttactacgaaacagcctgtctatggaatgagtgttacaggaacagattgttaactgtgggttgacagcggttcctgtatattctgtttctgtactttattgtcctcctgagcatccagtttccggttgcggacatagagcagcatatcaaccgtaatttcagtgatattcaggacataaaacgccagtgccagatagaataaccaatcaaaagcccctccttctgctatctgaagccatttacgtaaaataccaaatacatatccaacccagataaacacttcaaatgtaaggctctttccctttgctgtcctggaaacccaggatttatagatagacaaaggccaggaaagtccaaagcagataatcattaatgcttccagtaaatttgtcataatacctctcctctgctaattatatttataaaaaccttcacctgtcttacgtcccaaccttccttcctcaaccatgcgtttcaagatttccggaggctccatagccggctctccagtcttttcatacaccgacttggtagcataataagtaacatccagccctaccatatcctgcagttccaacggtcccatgggatgtcccagccccagtttagccgctgtatcaatgtcctctgccgttgcaaggcccttttccagcatacgcattgcattcaggcggaaaggatactgcagatagtttacaataaagccggggtagtccttagccataatcgtggtttttttcaaatcccgggcaaactccaccgccttgtcaacaacttcttttctcacaacatcggtacgcacaatctcacacagcttcattgcaggcaccggattgaagaaatgaatccccaccagtctggatgggtctttcatcccggctgcaatctcagcgagggaaagactggatgtattggtggcgatgatgcaatccgcgctaaccagatcttccagctgggtaaaaatgccctgttttacttccactttttccacaactgcctctactatgacatcacggtccccaaggtctgtaatattggtggtataacgaatggcttccagggttttatccatcacttcctgttccatctttcccttttccacacgcttacgaagagcgttggcaatactctccttcgctttttccaactgggcatccgatacatcatacaaaattacatcatatccattctgagccgctgtctggccaataccattgcccatatttccgcttcctgctactccaagtttattcatcgaatttactcctcttttaatttttctcaaacgccatcgccataccaagtccgcccgccacacagatgcttgccaggccatacttcgtattcctgcgcagcatctcataaatcagggtgatactgattctcgcaccggaacagcccaagggatgccccaaagcaatcgccccgccgtttacattcacaatatccggattaagctccagctccttgacacatgcaagggactgggcggcaaacgcttcattgatttcaaccaagccgaaatcatccagtgtcaatccgttctccttctccatacgtgccatcagctttctggtggcgtcaatgggaccggttcccatatatttagggtccacaccggccgcagccgctcctatgatagttacaagcggctttacgccaagttctgccgctctttccccgctcatcagcagtaaggccgccgcaccgtcatttctgccggaggcatttcctgcggtggtcactccaccctcaaaaatcggccggagctttgccattttctcagcactggtatcacgccttggatactcatccgtatcaaagcacagcggatcctgttttctacggggtatatacaccggcacaatttcatccttaaaccgtcccccatcaatggcttcaatggcctttttctggcttgccaggccaaatgcatcgcagtcctcacggctgataccgtatttttcagctacattgtcggccgtctgaatcatgttgaacgtaccatagatactctcgggctggctcttcggctggctctcaatattggggtccacaaacacactgttcccgtttccaacgccgaacctcgccccgcggatgtaaaacggtgccgtactcatgctctccacaccgccaaccagcactacatcagagtatccgcactgaatctgctgcataccatttaggattgcctgcataccggatgcgcactggcggtgcaccgaataggcaggagtggactccggaatgtggatagacagggctgccacacgcgcaatattaggggcgtccgtgctctgctttgcctgcccggcaattacttcatcaatgacatttttatcaattcccgccttttcaattgcgccctcaaacgccaccgccagcagcttttccggcaatatatcctttaatgtcccgccaatggatccaatgggtgtccttgcagcagaaaccacaaccacttctttcatctgtcttatcctcctttaatcaaatctcctattaaccatccgacatctattaatagataacctcttcctgtatataagtctcaatttcttcttccgtcagaccaacccactccttgaatacttccttgttattctcacccagtaaaggagatgccttgtgaataacagccggagttccagacattttccatggaggtgtgaccacaacctttttcccaagatatggatgttctacttccaccagcttttccctcgcctttatgtgggggtcggccaggatttcctcagaactgaacgacggcattgctgctacccctgcctcctggagtgtatgcatcagatccatgctgttataatgaatggtccattcagacatatggctgtcaatttctctgcgattggcaaaacggcctgcctggtccgcatatgcctcattctttgtccaatccgggttgcccatgacgttgcacagggaatcccattcttcatcattggcaaccgcaatgctaatccacttatcatctccgtcacaacgatatacctgatgaggtgccatgatttcatcctggttaccgcaccgtgacggggaggtaccattcatcgcatactgcagtaattccccgcccaccagggagctgatacactccgatgatgacagatcgatatactgcccctctcccgtcttatcccggtgaatcagagcggccaacacagcagacgcggccatggttcccacccgcaggtccataacaccgctcatggtattgggttccccatcctcataccctgtcagatgcgccaatcctccgaaggatgcaaaaattggcgcatagcctgcaaaatgtccgtacggtccttttgcgccaaaaccagagcaggaaatcatgataatatccggttttaccttttttaaatcttcatagcctaatcccagcttatccataacgccggcacgcatattctcaaacacaatatcgctggaagcgaccagtcttttagcaagttctgacccctggggattcttaagatccagtgttacactctttttatttaagttagcattattgaaaacaggagacgcatcataaccttcataatcctctcccagagtcatggaaccctgacgggtctggtcaatcctttttttactctcaatcttgacaacatccgcacccagaaatgaaagcagcagcgttgaataggggcctgcccatacccagctgaaatcagcaattttaattccctttaatgcttcattattcatctcaaactcctcctgtcttaaatcactccggcttctttaaacttcaccagttcttccctggaatagcccagttttttacaatatacttcctcattgtgttcgccaagcatcggagcagcaaagttatctgttggagctgatgcggacattttaaatggaagtcccggatacttaagagcacctgcctttggatggtcaatctcaacaaaaaaatcacgggccgcggactgaggtgatttatatacctgctctgcggtacagattggagcacatgccgtaccttccttctgtatcaggttgaacagctcatccgcagtatattttgcggcctcctgattcagataggcagtcaactcctcaaaattatcctcacgcagtgtgtgggtggaaaactgctccagattggtccactccggagctcccagggccttcaccacgccgttccactgtttatccggatgcagtacaactttaacatacaggccgtccccacattttaacaaggtatcacgcaagcgattaatctttactcgggttggattcttgccaagctcatagaaacgaacaatattcatacgctccaatgccatctccgcttcctgcttggaaatatctatgtactgtcccctgcctccgtgcatcttccagaacagggctgccaggatactaaccagtgcgcatgctcccacatcccgctggccaaccattccgccgccgcgcagcggttcccggtcagcgttcggagagttggccggcaatacatatccagcgccgctggcatgatacatgttgagattataagccttgtaatcgcggtaaggtccggtctgcccaaagggtgtgatggataccatcaccagcccgttattctgctggctaagatcatcatacccaagtcccagacctgccagctctcccggcgcgccgtcctccagcagaacatccgcctccataaccagccttttgaaaagcctccgcccggtggcactctcaatattaagcgtaatcccctttttattggtattatcaaacaggaagcctgccgccaggtccggatccggtatattgtccttaaacggccctcttcttcttgctccatcgccttccggcttctcaattttcagtacttctgctcccatatccgccagcagtttggcacaatacggacctgccacataactacagtactctactaccttaattccacttaatggtcctttagccattgtctattactcccttctataacggaatatttccatgttttttccatacgcggtcgctcttttgctttttctccatctggcggagagctttaatcagcagcgggcgtgtgtctctcggatcaatgatatcctccagccactgtacatgtcccgcatgatacggaaactttccaaatgtggatttatattcttccacccgtttagcccgtacctcctccggatgttcggctccttcaatttccttcttatagatgattgataccgcaccttccggacccatcagtcccagctccgccgttggccatgctaacagcagatctgagcccagaggctcagagcacatggccgaacttcctccgccataagccttgcgtatataaagtgtaatcataggtacggtcgcttcggaaattgcatataacacctttgcgccatgacgcaggattcctccatgctcctgttccactcccggcatataagccggagtatccacgaaaaatacaagaggaatattaaacgcatcgcagaagcgaatgaaacgtgcctccttatcgcttgcattaatgtcaatggcacctgcttttgcctgcggattgttggcgataatacccaccgtatgtccatccaacctgcaaagtcctgtaatcatattgggggcataatctggttttaactcaaagaaatagccatggtcaaccacatgactgattagttccctcatgttatacgccgcatttgctctgtccggtacaatacaaaggagctcctcatcccggcggtttggatcatcgtcacattcataaaccggtggtttctccgtgttacaggcaggtaaaaaacccagcagctctcttgtctgcatcagacattcctcatcattttctgcaaccagatcacagcagccgctaaccgtggcatgaaccatggcgcctcccagctcctggtcggtggtatccacaaactgtgctgccttaatcaacgatggggacgccacatacatatggctggtgttctttaccataaaaacaaaatcagtcatagccggggaataggctgcacccgcagcgcacggccccatcatcagcgtaatctgcgggatgacgccggatgccaatgtgtgctggtaaaacatggccggatatccgtcaaacatactgcgcgtcaccgcatcctggatacgcaccccgccggaatccaccaaaccgatacagggaaccctctcctccagggccctgcgcatcacttttacaatctttttacccgcagtgcttcccatggttcctcctaaaactgtaaagtcctgcgcatacacataaacaggtcttccgtttacctctccgaaacctgtgattactccatcacccggaagttctctattatcaatgtcaaaccccgtcatccgcggttttgcccagatatccagctccgtaaacgtgccgtgatccaggaagatatcaattctttcccttgctgtcagcttccctctggaatgctgtcgctccacggctttggctccgcctccctgcatcaaaacagcacggcgagcctcaagctcctgcaatttctcctgcatacccatatttctatctcctttctgcattgcatgaacaatcttcatacccctactttactacttacaggcttgacaacggaattacatttatgctaatctaatgtcaaccaaaagtttacatgcagataaggggtatatcatggatgataagcagctttattctcttttaaagattgtggaatgtgggagtttcagcaaagctgaagaggtactgttcctctccaaacaggcattaaaaaaacagatagattctctggaagacgaggttggatttcctcttacaatccggacccaccagggtattgcgctgacaaaagccggcgaagaattctgccgcggcatacgaagagttttggcagaactaaactccgtcacccagcactgcaaggaaattgcctttaatgaccaggtaatccgtatcgccaacccttatcatccacgattgctgctggaagatgctttcgatgaatttgcccgcagatttcctcatgttaaacagaacatacttttacagaccacagaacatctggttgaagacattctcagtgaccgtgcggatctggccgaatgtacctaccatcagaagtttgaagtgccgggagtggcctgcaccaagctgttcccgattccttataaatgtcttctttcagctcatcacccgttggcggacagacatatgatactgcagtccgaactttccggctttcaggtatatgtccgtcaggtcgatgccgcgctgatatcccaactaaccgagaactgcagcgacatcaagcttaactacatgaaccgcaataatataaatgatatcattaacatatgttataataatggtattttcatttccaaggcttattacataaacgcaatgcagccactgataaccgtaccgatagaaaccgatattgtaccaatggctgccgtactgcaccgcgagtctcctaactgggtagtccaggagtttataaaagtcatacgcagtctgcatccttacgatgattcgcaggataatacataaagcggggctgcaccccctctttcactgctttacgggatacctgtccatgctggtacaggtattccagataggccatactctcccacatcaccgaccgcaccccggaagtatctcctctctccctcacatattccaatgcgatttcccatgccgaatgaaagcccatgcagcatttctgatagtaagcatctgcttttttcagataatgattcctggtgtcctgcgctctgtctaaaggccgttcaaaagcccacccatgcccgggcagtacagtaagctgcgaaatatcatactccggcagcacggataacgtatgaaccgcagtcttaaccggattcccgtcaccaaaaaagtgcagaccaattggcgcaaaactggctgggagcagcaggtcacccgaaaacatcacttgttcctccggccaaatcagaatgcattgtccgtcggtatgcccggggacatgaagaaccctaagttctcctgtacacaccggaaaccggctgttttcgtccatggcaagaatcttctgtctcttttttacaaaggctccccgcaaataagactgtctgcgcacctctttttcccaatctcctgtcattccatacatccgaagctgttccataatacagcggacgttttcatccatactatcccactcatgataataggactgtatatccagaatatgcatgtagacagaggcatgggtccactcctcaaaccaaccggacataccagagtgatccgaatgataatgggtcagtataactgtctcaatggtatcaggcgtaagccccagctctttaatagcgatgttccaggcgttctttcctgtttcattataaaatccagtgtcaataatgacccagttatttcttcttcctttcacaatgtagctgtttaccgaaccggaaaaacgcactcccccttctgttgttcccgctatctccatgggcattttcagtctccatacctttccctttactacttcctttaatttgatttctgattccgtcatctacatataccgccgtttcaaagagtatcaacaatacttttccgtctcttccacactccggaacaaaaataaatcacgcccggtattgctgctccaaagggtgcaagtccatatccaagcacaaatccataaaagccccagtccatgaaaattccaaagaaataactaagtccgattctaaataccactccgtccagaatacccagacaaaggcttaactttgcattgccaattccctggataaatgaattgctgccccgaagaattcccagtccgataaatgtccatataatcgccctgacaaaaaccggcgccatgctgagcacctcaggatcagaagtaaacagtgcaaataactgacgtccaaacatcagatagattaacataaaaataccatggaacacgaagctgtaaatccacgcccaatataccgtggactttacccgtttcattttctgggcggcataattctgggcaatcatgggtgacgcggcatacctgaccccaagtgaaatctttgtacagacatcatcaatcttgattcccaccccaaaagcagcagcggccaccacgcccgccttgttaatcagactgttcacataaaacatggaaaaatatacagcgctggatgataaggccagggggattccctgttttgcaatagcctttaaatagaccggattcattttccagttttgcagtttaaaatcaaatccaaattgctcttgatggtggtacaggaaaaacagcgaaaatatgaaggagacagcctgaccaatcatggtggcagcggcggcgccagccactccccagcccaggtaacctgtaaacagcaagtcgagaaccagattcaggacagatgccagagtaatgaacataaaagggtgttttgagtttcccattccccgcagcacagcagataccatattatatccaaagctgaacagaaggcctataccacatataacgagataatccacagccatatcatatgatggggccggggtgttcagtaaatccagtatccgtgtgtggaatgccagcagcagcactgaaaaactcaatgccaggagcagtacaaaggaaaacagggttcctgtcacccttcccagctcctgcttccgttctgctcctatgagctgtgaaatcagtacctgtcctccggtacaaagtccggtacataacattgtcgagaaattcaaaagctggccgcacatagaaactgccgccagacctgcctttcctacaaactgtccaactataatcatatcaaccgcggaatacaaaacctgaaatgcattagacgccataaacgggagcatgaaaacaagcatggattttgggatgttttcctgtgtgaaattttttactaatgcggcactcttgctcattttatcactcctctgtctttgattgtttcgtttcttatattttaatagattgaaaatgatttttccatgagtttcattttcactatatgtcaatctgtggttgacgcgtatatccacagaaagactgtaaacttttagttgaccaaacggggaaacaaaactcattccgccctaattccatatgtaataaaataagctcataaaatcaggtgcatatgttaccggagaggaggttacaatgggtgaaattaccaatgctactgtctgcctgctggggatgggaaccgtatttttcggattaatcatgattgtgtttttctgtaaactgatgagcgccatcatacaaaggtatgaccgtgattcatcgccggacaaaccacagcaaacagccccagttaccgcagtgccggaagttcccgctcccataccagaaaacttggagattgccgtatccgctgcactgtctgagatgttgaatacagatttatccaatatccgtatttcatcatggagggagtaccaggaaacagaaattcctaaccgtcaggaagtcgtggcagctgtttccgctgccatagccgaaatgttgaatacagatattgccggcatccgtattgtatcgttcaaacaactataaataaacaagaaaaggagtttttattatgagaaaatatcgtgttaatgtaaatggaacaatgtatgaaattgaaattgaggaaatcaacggctcctcctccatggcggcccgtcagaccgcccctgtccgtaccgctgttcctgttaaggctcctgtcccggctgcgccaccaaagactcctgaagcatccaggactccggcgtcatcctccgcggaaggtaccgcagtatgcgctcccatgccagggaatattctggaggtacgtgtttcaggcgggcaggcagtcaaaaaaggcgatgtgcttgttattcttgaggcgatgaaaatggaaaatgaaatcatggctccctgcgacggcaccgtaacatctgtcagtatttctgccggggctgccgttaattccggagcgctgctttgctctatccaataaacaacgtataacggaggagttattatgtcaaaattcatcgaaacaaccggtttctacctgcttctcaaccagtttacggaaagcggatggaaaacctttcttatgctctgtgtctcccttcttttactgtggctggccatacataagaaatttgagccgcttttgctggttggaatcgccatgggggtgcttgtaaccaatctgcccggtgcaaatctctaccatcccacactatgggatgcctatacctatgagtgcgcctacgatgctgcaaatgatgcgatactttatgatgtagacaccagtacagctattgattctgaaacctacacagcctccctttcgcaaggctctgctccgccaaagattattgaagaactctcctttacagacatcgctcactatggaggtcttctggatattctgtacatcggtgttaaaatcagcctgtatccctgcctgatttttattggaattggagctatgacggacttcggtccgttgattgcaaatccgatttcccttcttttaggtgctgctgcgcaggttggcatctttgcaacctatcttacctgcaccctttcgggcctcttcaccaaaagccagggcggtgcaattggaattattggtggcgcggatggtcctacggccatctataccgccagccgactggccccggaacttctcggtgccattgccattgccgcctactcctatatggcgctggttcccgtcatccagccgcctatcatgaagcttctaaccacaaaatcagaacggcgtataataatgaaaggcctgcgtcctgtcagccaaaaagaaaaaattattttcccaatcatggtcgtcatattcgtatccttactggttccctcagcagcccccttaatctgctgcctcatgttcggcaatctgctgaatgtctgcggcgctacggaacgtctgagcaaaacagcccaaaatgagcttatgaacatagtaaccctgtttcttggcataagtgtaggggccaccgcctcagcagaacgctttttaaccatgagaaccctgggtatcctggtaatgggagtgacagcttttgcactgggaaccgcaggaggtgtactgctggccaaattcatgaacctgttcctcaaaaataagattaacccccttatcgggtccgccggtgtgtctgctgtgcctatggccgcacgtgtgtcccagaaggtaggacagacggaagaccctggcaatttcctgctgatgcacgccatggggccaaatgtggccggcgttatcggatccgccattgcagccggtattctgatttccctgctgggctgatcccgttccgttttaagaaaggagaatccatatgtccgacaattataccggactaccattcgcaaacaacaaacctctgaatattaccgatacgattctgcgcgatgcacatcaatcccaggcagctacccgcatgcgtatagatgatatgcttccggctctggagcagttggatgaggtcggttactggtccctggagtgctggggcggcgcaacctttgacgcatgtctgcgcttcctgaacgaagatccctgggaacgtctgcgtattatcaaaaagcactgcccgaaaacaaagcttcaaatgttgtttcgaggccaaaatatccttggatacaaacactattccgatgatgtggtagagaaattctgtgccaagtctattgaaaacggaatcgacataatccgaatctttgatgcgcttaatgatccgcgtaacctggaacaggccatcaaatgtacgaaaaaatacggcggatggtgtgaagctgccatgagctataccatcagtcccattcatgataacgcctattttattaaacttgcaaaagaattggagcaaatgggcgctgattccatttgcatcaaggatatggcatgcctgctgctgcctgaggtggcctacactcttgtaagcgatttaaaaaaggagattcatttaccaatccatcttcacacccacaacacaaccggaacaggagatatggttaatttaatggctgcatatgcaggtgtagatattgtcgactgcgctttgtcgccgttagctaacggtacgtcccagccctccacagaggcgctggtggtaacacttaagggtaccccccgtgatacagggcttgagctgtccaagatgaacggacctgccaaacatttccgtatggttgccgaggaactgaaaaaaaggggagacttaaaccctaaagttctcaatgtggataccaatacactgctctaccaggtgcccggtggaatgctttccaacctgatatcccagctgcatcaggccggaaaagatgaccagttctatgatgtgctggaagaaatcccacgtgtacgaaaagatttcggctacctgcctctggtgacccctaccagccagattgtaggtacccaggctgtcatgaacgtcatcaccggtgaacgctataagatggtccccaaagagtccaaaggtgtacttaaaggtgagtacggtaaagttcccggcgttatcaatgaagacgtgcggaaaaaatgtctctcaaccgacgaattgaaacacatcataacctgccgccccgccgacctgctggagccagagtttgaaaaataccggaatgaatataaagatatatgtaaaagtgaggaagatgttctgtcctgtgcgctgtttccgcagattgcccccaattttctgaaacagcgtaatgatcccggcgcttcccggaccatatctgaatctgaggaaatacgtttactgaaggttgaagatttaaccgcataaaccacacttcccaggtaaaccggagctgttacatgacaattacatagtgtaacagctctatttttcacaaggagatatagacatgcaaacaaaagtaatgactgcaaaagaagcgattaattcctatgttaaaaacggggactgtctggcaattggagggtttgttaccaatcggcgtccttatgctctggtgcgtgaaataatccgccagcatattggaaacctctatattgaaggcgggccttcaggcggtgacatcgacatgctgattggagccggccttgttacagccataaataccgcttatatttcaaacgccgctttttccatggtatgcagaagatatggcgaggctgttgtacaacataaaatcttgaatgaagattactccatggatgtgcagaccattgcatatcacggtgctgccttgggactgccctatgttccggttaaaaacatgcttggatctgatttggccgacaaatggggaatatcagccgaggaacgaaaaaaacatgataaactgcccaaccagaaatttatactgcaggaagatccctttacccctggcagtatgctctgtcttgtacctacaccgaaaatagacgttgccctgattcacgcgcaggccgccagtccggatggaacaatccgcatagcaggccccctgttccaagatgaggatattgccatcgctgccagacataccattgtctcctgcgagacacttatgactaacgatgaaatccggaaacatccggaattgaatacactgaccggcctgtgtgtggacgcggtggttcctgccaggtttggtgcaaccccatcccagtgttttggctattacgattatgatgtccgtgacttacgggaatatgccaatgcaagcaaaacacaggctggctttgactcgtacatagaaaaaaccgttcacttacaggataatcatgaagcctatatcgcctctaaagatccttcctggctggaacagctgaccattatcccaaatatgggatatgtagcaggattaaattcaatggaataggagtgactaaacatgaattggacgaaaagacagataatggcaattgcacttgcaaggcaaatcgaggatgagaaatcctatataataggaacaggcctacctcttattggtgctacccttgccaaaaatacacacgcaccgaacgctcactttatatttgaatcaggcattttcgaatccagcccattggaagtgccaaaaagcgtgacagatctccgtttaaacatgcaggcatccgtactgtggccccaatatcgctacttcggctttcaggcgctttcagctgaacgcaataacattgatgcaggttttatcggcggcgcacagattgatccttacggaaacatcaactctacctgtatcggcgaatatggtcaccagacttcccaattcagcggctccggcggagccaacggaatcgccactttctgcgacacggtcattctaatgaagcaccagagaagacgatttgttgagcatgtggactatatcaccagccctgggtggattgacggcccctcgggacgtctggaacgcggcctgattcctgacaaagggccgcgggccgtcataactgacctgggcatcatgcgattcgacgataataagcgtatgtatctggccgaatactttccaggagtgacccggcaggaaatcatggacaacaccggctttgagctaaataccttaaatgcggttcagtctccggaaccggatgaataccttctggatgttttagttaataaagtggaccgttaagccaataaagactgtgttcaaaaaaataaccatcctgccggcaatatcatattctgattgccggcaggatggttatttttttcatctgttattttatgtatatatttatccaatcaatccgattcctgcatataccatggacagcaatggaatgacaatgacacagcagagcatgcccaccagtgtaatcggccagttgcccttgatacagtccgtaaagctgtaatgccctgtaccaaaggtatactgccaggtcccctcaatcggaaacaggaaaccggtacctgcctgtattccaaccaaggccatggctgccgctaccggaacgcctgcacccaccagaacaggggcaatgacagttgcgctgagcgcgccgtttgcggatccctgaggaacaaggcagtgtaccagaaatgccgcaattgttgccataataaaaattaaaatcaggttccagcttgcggaatccgcaaaaatcttatttaccacccactctccggcgcccgtactgctcatgccggaagccagagggaaaatacagagcatggtaacaatcaccattgcggaaaaattctttttataatctttggcggaaagcagattaacgcccggaagcatcatcagaaacataccacccatagccacggtagcggtatccaatttttttacccagttacttgcaaaccagagaacaatcatgacaagggttattgcaatataccacttatcctttttctcaaaatggttgggtattgatgaaaacaatttctccacatcactcttttgctgacttgaaagctgctccggtttaaaatatctcggcagcataaaagcgccaaaaatagtcagaatcagaccacagggaaccccgaacaatgcccactggaaaaaggtcattggggtgccggatatcacctcgcttaaatccatgatagccacatttacactgtttgagcacggtaaaaacaaacctcctgtaaacgctcccaccgtaattgccatcatcaaacctcccgccagacggctggtccccggctccggatcaccgaatgctttgacaacacccgtcaccactgccagaaccacaatctgagccgctccatccgatacgaaaatggagataatggcggacagccagcacacggcactgatcattttccgtgaatccccctttcccaaacggtacaaagcccttaaaagaatcgcggccagatttgtgttttgcagcgcagcgcctatgccaaacccggccatgcaaaagaataccgtactggagcaggccgtctgctgaatcgtcttccacggcatgacccccgtatatttcatggcaacaataatcataaaacaagtggctgccagcggaatagcttcactgataaaaagaatcatcgctccaattacaatagccagcatagtccatccctctggcgccaatccttctggcggcgcaataaccagactgctgagcaccagtatcactgtaattactatacaccccatcttaaatgccggattttttttcagattatccataattaccttcccccttatattatgcttttgccaattttattaactcatcccatttttccggaagcttcaccgcacggctagtcatcttaccctgcgtgtaattggaacgatgaaacacactgcggtttctggtcatatcccccacaaccagaacatgaatctttacccccggtccaagaagcggtaccatccgtttcggatcatccgactcataccattccgggcccaggcttcccttttccacttcttccttcaagctgtagggcttccaattattaaaacgggagctgttcatctcaaagtattctgctgtgacctttgcgcggttccggatgtattcgtcaatcttttcctttccatatccctgtgaagccagaagttttgcaacaaccgggctcaaaaaaagaatatgattctcaatgtagccgcgcatagcctcataaggctcaatcatgcgttctacccactcggtaatgtaatccagatgctgctccgctgtatctccgtttgtctgaaccggatcactctgagccctgccggaaacaatggtcacaacgttctcgccataggtaaaaccctgagtctcgctcaaagtcttaaaaccaatctcatggcatacctggtcattctcaggcgctaccgcgcggaacatttgtccatgggttgacatatcggtagaaccgaccagtgatcctgccacatttctcagaagcagcctgtaaaaacggccgattgttacgtttggctgggttcccggcctctgatgcccaatctgataattaaagccaagctggtcacggatcgccccattcagcataataatgggttcccatccgggggttgccccggaatcttttaaactgaactccggatccgacatgatttcggcaatggcaagcagaaccggcatatactctggcctgcagcctgccatgacgccgtttacggcaaccttccatacggtgcaggctcccatggccggttccaaacttcccaatacctcttccggggctcggtccgtaaaccgcaggaactcatcaaccctatccaaagtcggcggtacaatcggaagtccgtctgaccattttttggagtagaaatattcctgtacctcttcgtatgttccctcaaacacaatatccctgtccgaaggccccctcttcttaggcttaattgtactcttaacctgctgcgtcagtgccttgatgagtccaggcaccacaatactgcgaatatttttttccatggtatccacgtcatccagtgcaatgggagccgggtactccacaatacgcagatccggaaatcccgcactctttgcaatctgctttaccataaaagaaaatcccttgcaaaggattccaactgccggcagacctgtctgctcgactaaaattcctgcccgtgcaaccgcgggcgcacaggtccctcagcagccatttcccacaatgaccgcatcacagccatacctcttcagcagctccggcagctccttcatcttctgagcttccatggacggatcatgaaaatttccgaatgttctaaaatctacaaatgtcacatccggatatttttccctgattgcttcctcaatgaccggaaaagtctcgtcaccccgaaacccccagttccacaattcgccgattacctttccatttaaatccggcagcgatttggcaacatttttttcctttgtagtctggatgcccgccggatataccacatgataactattacacatgattctctccctgttattttgtgtttatcctaacattgttagttattactttatttattatagctaacaatgttagtttggtcaaattgaacatatgggtccattgatagattaatagttatcattcgaattattctttttgtgttatctattgattaatcggatttgattgacgaaatcctggtggtatgatacactcagttgtataaacatctctcaaatatcatcatgatttcccaacagaggattttaaaaatggacacttctaccttacggtattttacggttgttgctgaaacacagcacatgaaccgcgccgcacaactattaaatattactcagccatccctatctacctccatcaaacggctggaggcggaaattggctatcagctttttgaccgttccgggcggggaatccaattaaacgactatggacgaatttttctgagaggtgtcacagaggcagaaaatattatggaggcctgtctgtctgagatgaatcagttaaaacagagttctgttaattttatccgcctgtcctgttccaactctccaagtaactccaaattgattgatatgcttcttgcaaaagacgtgaatcttcgtgtttctgttatccctcagaactgggaacaggaacttcttagtgataactgtgatctggtcattaccatgggaaatctgcaccactcccgtatagaaagagccattctgcgcccacagcaaatcgttatggcagttgggaaaaatcatcccctggctgcatccgattcacttactttgcaggatgtacaccgctattccttctgctccacggatgccccccactccatcataaatattgtaaaagaacagcatccggagtataatctgcatccgcgcattacttttttgggacgcaattctaacgatatggtaaaagccatactatccggccgttatattgctctgatggttaagcaaaatcttccggaaacagatgacctgcgtatcctcaccctctccgattttaatttgtctcttccgatttatctttactggcgggaaaaggatacactaaatccagtttctaacactatccgccgcagtataatggatttttatcagtcattgtctgctgaataggcagatgtccttgcgtaaatattccaacacaaaatgagctgctcatcatgaggcagctcattcgttataaaacaagtatctaacgttaaattctaaaaatattgcagagtcccaacaaggcggcaattgaggtcaacaccatcataacaatggcaagaacaaactgttgttttaccaatgaatcggcaagtttatcatccggggccagacctacaaactgagcgcccgctgttgagaatggtgagattggggtggacagcgctccaatctgagctgctgtgtatagcgctactacattcagacccgtcgctgttgcaagtgccggtaccattgggaacaaaagcggaaggacaacgctggttccactggcaaacaggcttaagaaagccgcgataagacagaataccggtgcaatcagaaatgatggtatattcccgccctcaaatacagcaaccacgctttccaaaagaccaaccttctttgccagttccatcaaaaagcatacccccgcaatagtaaatacagttcccatcggcattttctgaagtaccttcttcgggttagcgatattcatgatactggcaatcagtgcaaatataatcagcaccgcctgaggtttacataaaccaaccagatgtttgaaggcaacgctgtcaaccttcacaaaagtattgagaatattaggaatgaccagcaggaagaacgaaatcaggattaaagtcatggtctttgtctggagcggagaaaatgcctccggcttttggttaaggatttccagattctttacctttggcatacccgggttcagcttcttctttagcagctggaacaggatataaaacagagcaaggaaaagtaccttattaatcaggaatgtggcatagcttaaaatataggtatgtatggcaacatcagcggccacaccgctttcctctaccagtccataaagcactactccggtgccggtccacggattctgcgtgccgcagttataaccggtatcaattgcgaataccatcagcaatggatcaataccaacctgctggcagacagagtagcccaggggagccaatagtacaatagttccaggtcccgcacccagcaggcccaaaacaaaggcaatgaatgcaaatgcaaaaggcagtgccggaatactctttctaaacttatataaaagtttgcttccaagcaatgtcagtgttccattctccctggcaaatccgtaaaacatagcggaagccagaagaaagaaaatcaggctgtccggccagaatccaaatatggttgccgccttttcccccattatcaggcaaccaataagaaaagcaaaggacattgcaataagtcccatattgataccggtcttaaaacaaattagtattgctacaacaatagcgatgaggcaaatgatcaaaatcgcagtattgcccatagtatcctcccattctctattttcttacattattaagaagctcatcccatttttccggaagttcaattttcttgctggtaggccagcccataaagccattttgagcaccaataataacatgatcacgtgccggatcaccacttactatcagctggaagtctttaggatccgcaatcatttggataaagcggttttctcccatatccttcagatttccattttcatcgtaaaactccagtttgccatcttcattcaccctgaagtctccgtattcttcctttgttccaatcagttccggccaattcccctgttcaagaccggtgacaaaacgctcggcgaggcggttgctcaggttccaaaggcggaattttgcgcctttaaagaaatgctccttaacctcgtccttagtataaccttctttaattaatgagtctactatggttggtgtcaggataaccaatggcatcagatgctgtccacggaacaggaattgaatgaacatatggttatctgccatacgcttttcaattgcagtaagaataccctctgccgtaggccatcccacttcaataccctgggttctctcagtacaggtcatgattgttatgacattatcttcgttcttaaaacctctgtccattcggtatggctgccacccaatgctctccagatattcatcattttcagcaagcacaatacggaagttatcaccatagcagcctttgtcggtcttatgcggcaggaagccgcatacgtttcgaagatacattctccaaaagcggcctatactggtgttggcctggaatccgggacgcaaagccccttgtgtacagttaaagttcagctctttcacaagactgccgctaaggattatcatgacctctgtcgctggtgtatgacccaggttctcctgcgcaaaatacggatcacacagcgcttcagcaattgccacaagaatcggcatgtattccggacggcagccgctcatcacaccattaacagcaacactccaaatggtggccttccgattgtctggtttaacaattcctaaaacctcgtcggctttccggtctgtaaacctcataaactcgtctactttttccagagtaggcggaacaatcggaagtccctcgctccattccttctcaagaaaatattcatttatctcttcgtaagtgccggaaaaaataatatccctggcacctggttcttttttcggtttggcgtcctttggctgaacagtgagtcccttaactaccatatccatcataatatctacagcattatcatatacctgctcattggcagttgtatttacatgacccggatgggtagcaaacggaagattgggatatccttctccctttgcagtaaaacttcctgctattttaaatccgtcacagcataaggtaacggtaggaataccaagcttttctactaaaatacttgcacgcgtcacggcggcgatacagctccctcagcagccaacgccacagataaccgcatcgacccccatttccttgaatttctggggaagtgcggcaagaacctccctttcatccgctccatgtatttcgccaaattccttccagctaatcagcttgattccaggaaagcgctttggtagttccttttcaaatgcctggaacataatatctcctttgaaaacccagtcccaaagctcggccaccacctttccctccaacgtatccagacgttttgccagtttagcgccctgcacagtactcggggtcaacggccatacaacgtcatactgatttgtgttactcatacaatgtcctcctttataattctcgcagtccggagcagcttcttccggcataatataaccttatccaatccttacatgtcagtccgtaagagtactcagatagcgattcagattcatataggccacaacgccgtcacctactgccgtagacatctgcgccggagaatttgcccggatatctccagctgcatagatgccgtctacacttgtcttcatgttgccatccaccacaacataaccattgggggtcagctccaggctgctctctgcatatgtagtgttgggcagcagaccaatacgaatataaattccctgtacatccagaattcttcttgcaccgcttgccctgtcctcaacttcaactccgtttacccattcattcccgttgattccaacaatctgagtattgcatattaattcaatattgggattttcatctacccggttaatcaggacctgggatgcttttggctgctccatgaattcgacaaccgtaacggtacagcctaatttttcaagcagcaaagcctctgtaagaccagaatccccggcgccagccacaactaccggcttacctgcgcactgtgcgccgtcacaagttgcacaataaaatacccccttggcagataattccttctcccccggaacattcagcagtctgggatgggaaccggaagcaagaattatacctttgcatgtataagagtcatctgtggtctttacaactttgtaatttcccttatcctggatggaaaccacctcacctgtttccacccctgctcctgctttatctgcctgctccagcatctgactggccaaatccggccccatgaccccctctgcaaatccaggataattttcaatgagctgacggttcatcatctcaccgcccatagcccccttttccaaaatacatgtctcataaccgccgcgggccgcatagattcccgctgccagacctgcacaaccagaaccaatgataatcacatcataatctgtaaacataactctctcctttttcctgattttagtaaccttttttgaagattgctttttaactaacaatgttagttgtattatagactaacgtcgttagttaagtcaagactcattatgctattttaaacaaaaaaaaactctttcagcagtttgccgaaaaagagtttttctttttgtctaaatttacttttacattcttatgtacgttcctcagtctgtgctttttgctcgtcctccatctggtttgcccatttaacatagatttgaattaaaaaacggaaactttcatctgcagttacattggtagctgtatagtatcccgacatttcataggagatataaccgtgcaaagcagccctgaagcaccgggaataattaattgcgttttcacgggatatcccatattgtgcaactacctgccggattacgcggacactctcacggccaagcgccaagctttcatcatgctttaacgcaggcatgcccataatcgcccggtagagttcataattattcttaacaaaatcacgatattcataggcaattgcttcaatcgctgcatccctggattttcctgcaactgctttctccagcgcatcattcatcagctcagatgcatagctcccaatttcccggttaatatcgtctataccctctatatgattataaagagacgccgccttacagtgcagcttctttgccaattcacgcattgagaagttattataaccgttttcaatgacgagttctgttgctgcttcaacaatacttgatattgtaagtccttttcccttcattgcttccccccttcctttaaatcaacagttaaatcttatcccgtattaaattttctgtcaatagtctctttaaaaagcactcccctgaaacactccccaatctatttacccaacatctttttctgagaaaattaaaaagccccgggagaatcatcttccaaggccaaggcatcttatagtttcctccatcatatctccagccagacagcatttaaaccactgtaacccaatggcattacaatagaaaattcttcacacacgtgggtgcggcaggactacaccaattggattgtttaattattatataatgattgaaccataatctctcaaatatgcggatagctgacaccatccgcatattccctattgtatggatgatataattcttaaccaaattaatccaagatactatatgggacatcattacctacatgcttaaagtatcaattccctgcgttgtagacgtcatagcctcgtccagcctctctgcctcccggacaaagacatgcgaaatatcaaacgcttccggaacatctgcaagcgtacaaacactcacacagtaattaatccatggaaatctttttgtcatccgatacacgatggtcattacatcaggttctgacatcggcataagggtatgatatcctgagccctggatatgttcaaagccatttttcttaaaaaagttcctgacatcatggtatgcattacgccagtccccttctgtatagtatattttcaatgcgtttgtatccaggtcaaaatttatccctttcttttgcccactattcatatactaattcctcagaaaccctgtaagcaggttttcttttgctgaaccattataccatgtacactcctttaaattctcagcaagctctggtgtttgcttcagtgcaaaaattgccgcccaaaaacgtccgtaatcctcctccctccctttatcttcatagactcggaccagcgctctgtccacgcagtttaaatcctcagactcaaatatttcgtccactttagcataaagctgttccaggatatccggttccagcctatccgtatcaaagctcaacttaactttgaacatctttatgtcctccctttccgatactgtcaattccatttatcatttacgaaaaccttattatttttaattcttctttatagcctactgttgttcttatattttatcattccgggtacccattagcaatatcagccaccaagagacccggaaaacgatttccactttgatacagtattgcttctaatcccactctggtttacagattcacatccaacatcatacctgtccttagctggatttgaagtttgtttttcgatatcacacgtatctcccggacgatctgccgtatgaagatattatcaaattcggctcctgaggtcccgcctgtctcacctatgattcggctgatttcctggtccagatactcgtactcgtccctcattttctcctgctctcgtatgctttccctcctcctttaacgtaggtgatttatggcaccgcttcgtcccatgctccagacgattgatgcagcgccatacgattaccttcttcccactttttgcccagattgtcctgcggctccgcattcattgcacaccatgattccggtcagtgcatatttagaactatatacgccccgggccgtctttcctttcctggtgagattcttcacatagtactgcttctgctggcccgagttcttcaccctccgtttagtcaggtaatccgctgtgaacgtcttttgtaacagcacataaaagcgcaatgtgtataccgttgtgccctgcttgcgaatattgaatagcctttggaaacaacttcgcctttagccgataaagcataacaagaattatgctcataatgtgcgaatcaatttggcaatatttctagcagctccgacaactttttaatactcggatacctatcactgttttcggaatttggttttgcggtaatcaacacaggctggatgccgcatttttgggctcctgctaaattctcaacaccatcgtcaatgaatatggtctgttccggggggagattcatctgctttaatgcgtgctcatacattagtttatctggtttgaatgtaccaagataactgctgaatgtctttgcctcaaagaaactatatattccgccatactctaaaattcgcttaattgacggccacgtatcggagataattcctagtttatatctgctttgcagggctttaagtgtagatgcggtatcatcataaaaacaatagttatccatatcatatacctttgaacgggcaatatcttctatctttctttcagtcaaattcagttcgggtaaatcgaaggaaagcatagaatagaacaccttaaactgttccaactcttcttcctctgtgacaatcaaatggttgtcatcaaggtacttcatagcatttgcaaaggccatatcttttctatcttttgggattgcggaaaatacatgtggatctatgtattctgcgcatttgtggggcataagccaatgttcggttgtagggtagaaaagtgtccagccggcatcaaagaatatccctttgattggagtataaagagccatatcagtttcccctttcgtatcttcgtattatataaataatcttccatataccttatacaacaaagacatatgttcatagtttgaagccaaaccgcataaaagtcaattttccggtggcatagataaatctttacacctatttttacaagctcttatatgtctttaggaaacttgggcggtatttgggcggcaaatcagcaaattttcatacaggcgagtttagtcgaaatccagtaaccatgcactttttcagcattagaaaacgttttgatgggctggataatttactattttttatagcctactgttgttcttatattttatcattccgggtacccattagcaatatcagccaccaagacccggaaaacgatttccactttgatgcagtattgcttctaatcccactctggtttacagattcacatccaacatcatacctgtccttagctggatttgaagtttgtttttcgatatcacacgtatctcccggacgatctgacgtatgaagatattatcaaattcggctcctaaggtcccgcctgtctcacctatgattcggctgatttcctggtccagatgctcatactcgtcccttattttttcctgctctcgtatgctttctctcctcttttttaattcgcttatctgtaatcccagctttcgcattcggtcgctgtaccagttctctccaccatgttccctggctgccatgcccacatagtccataagctggtctcgcagttcctctatggttttatcaatctcttcctctgtgcacgctcctccaacaaccctggccgcccggaggatatcttcctttaccccgtttaagaagttttcttcctcctggtcaattgacaggctgtgcagctttcccatgattgcttcctgaatgacttcctcctttaacgtaggtgattcatggcaccgcttcgtcccatgctccagacggttgatgcagcgccatacgattaccttcttcccactttttgcccaggttgtcctgcggtaatgggctccgcattcattgcacaccatgattccggtcagtgcatatttagaactatatacgccctgggccgtcttccctttcctggttccggctttttttaacgaggagcgtcgggcaatctcctcctgtatcttataatagactgtcttcgggatgattgcctcatgatgattcttcacatagtactgcttctgctggcccgagttcttcaccctccgtttggttagataatctgacgtgaatgtcttctgcagaagcacatcccccatgattttttcattgatcagtatgttgtagatggtacccgtactccatattttcttaccggtggtggtctctatccctgcgtcctccagtctgtgcttgattcgttccaggctgtccccatccaggaaccaccgggccatgtttcggataacagcggcttcctcctccacgatgcacatctctccggttggcgccttcctgaatccatagcttctctgtcttgtggattcccccttttcaaactttctcgcatacccccacttgacgttggtgctgatggcacggctctcctcctgtgcctgactgctcaggatggtcagtatcatttcggttgagtcatccagggtgttaaggttttccttctcgaagtacacggccacgttcttttccttgagcttcctcacccaggagatgcagtccaccgtattcctggcaaaccggctgatggatttcgtaatgaccatgtccaccttccccttcagacactggtccatcagctgattaaaatcatccctacggaaggtattggtcgcgctgcgtccatcatccgcgaagacaccggcgaatatccagttaggattctgcatgatgtgcctggtataatattcaatctgtatgtcataactggactgctgctgttccagctccgtactgacgcggcagtatgccgctacccgcagcttccgaatttcccgggatgactcatctgtcgggttccaggtggccgggatgacctctacgattcgttccgcccttggcacgtaattcctcctttccatctgccgccttagtccggctctcccgtttcttccggccggtttcttccaatctggtctgtacttgtgtaaacagttcccgtgtcaccagagcgggaaatttcttatccccaaggtaaacagggttggtgaggatatttcggatgcagctgtggctccatgccggctttcctttctggttgggtatggactgatgtaccagctctttagccagagtggtcaacgatatcccctccgcataagattggaataacatctggacgattggaccgtattgttcatggatgattggcacttcctgtccatccagccagtatccgaaggggacgcagtaacgtatgtttttcgttttcttatcttttgtttttatttctggatattgaagtaccaccgctctatttatcagctcaaatttcaggcttctgtccggctggacctctaccctcttgatgattttgaatacggatgcattaattgctacggacaaatcggcttcttccacctggatagagccatccaatccccgaaggtaatcctctatctgataggtcaagtctgtcagttttatctcctggtatcgcttggcagcaatctgaaaatatagctgctctatccttttatagtcttcattgcatttgttccagtccccatttaattcagattccatgcgctgtctttctttgatgattccggtcagtatctttttcgtttcctcatggtacagggccggctctgttttcatccgcacaagtgcttgtaagaacagtccatccagttgcttctctgtcaagatgggcatcttacatggttccttcgtggccgggtcgtaatgtctgcatttccaataccgaacatccctcttgtcacctctaccactctgtttatagatggcatataccccgccgcagctgctgcatatcagccggcctgtatacatggatgttctctggatggagccggatggatgacgctggttccataaatcccgggagcgtttcagttgttcctgtacccgtttaaactgctcgtcttcaatcattctcgggtacggttccactcccagatagtccttgttactcaatattttccggataagggcgggtgtccaagatggtttcccacagacggatggtaccttcttgtcctttagcatcccagctatttttttgatggattcccctccatcatatgcatcaaagataaggtgtacagcctcactctgccctaaatccattctcatgtctccgtcaaccagacggtacccgtaggtgatatagttgttcacatggcatccctcctgtcatatgactggctcatatagtttaagtccgcaccgtagatggaagcccagttcccgttcctttcccactgagacttcccggaccaggaggataaactggtcaccatcgaattcctgcatcttcccatcatatccctggagctgatgcagagcggcctgtaatcctgtgatggtatcctggtggatacctctactgtgcagctgtttctcttctgacctgcatctgcttagctcctgttcaatcttccggctctcctcaaaataaagagcagagtcgatacactcatttgcttttaactgcctgagtatatgtctctgctcttttagttccagtttcttttgatttaaggtatccaatgcctcatgaagtccattggtttcctgcatcttcttcatcccccggataactgggtccactatctcgtccgcgtgctctttcagggtgttgaatgtatttacaaacattctttctatatctgcttcccaaatctcattggtatagcactggcatgcctctgaccggtggcccggacatctccacttgatggacactcccttttgtctctgctccttcttacggatgaacactctcccgcattccccgcataccaccttcccgcttaggatataggctccctcgtttccacatgatttcatcctggcccgatggccaagacggtgcctctttatctgttgtaaccgcatctgttcatccctgcacaggataccctcatggtcatcccttataaaatactgtggcttcttcccatggtttctctctgtccggaacggcactgtcccggttgagtaagtcttctggtgaaggcagtcacccactgttttctcgttgaacaggatccgcaggaccgcttcggaggaccagagcccaccatacggcgccgctacttggttctgattcaggtattcggctatcctcaccccgctcattccgttcatgtacatgctggccatcctgcggacccatgctgcctcatccttcttgacagccagctccttcgcttcatccttatcgtaaccatacggccgcctgcttatcacgaatgtaccatgtttgaaccggttcaccgctgaccagtggacgttttgggatatgttctctgactcctgctgtgcaaccgcaccgtatacggtcagtatcccttcactctcctccgtcatggtattcaggcgttccttctcaaaatacacacttacccctatttccttcagatggcggaccgtggataaggtgtccaccgtattcctggcaaaccgggtgattgatttggtcagtatgaggtctatccttcctttttcacattcctccagcatccgctggaagtcctccctcccccatcgtctggttccgcttatgccctcgtctgcatatatcccgcagaattcccaggccggatttttctggataagtcctctataatactccatctgagcgtcataggaatgatactggccatcggcatccgtgctcacacggcagtatgcacacactcgaatgctccgtatctggtatcctgtacgctctggtttggtctttgggatgcatattacttctgccacttgctgcgcctcctttcctccgttttcaacaagacacattaccacacttcctgcaccatatcaagtatcagttctccgaattctcacattttcatacaacatgtcgggaacatatcctctggtacttccgaaggaccatgtcatacatgacagggtcaatcagcctttggcgcagcagctcatccaatatcttttgtacttccctgaatcgcaggtattgaagcagctccattgtttccatagttcctccgggaatactctatttccacctcacggatttcctcatgtgtatcgctcctggcctcgttccatcccacatccatgcagtcatcccggaagaacggctgcatgatctgacatcgaacccaccttctctctgtttcttatttgtgcttctatttgacactactccccgaagcttgtccggaaggatatctggacagggcagtcagtccgcctgcctgcagcgtacaggcatcataggaattccacctcctccgggttctccgggggccgccctcattgcgtggtccccggccaagggggctgtgactggacggaagtatcattgtcagctgtccgggattatggcgattcaaccctgcttatgattgattgggagtcgggtgtgtaccgctcttgccttaagatgtattgcatatccatggacaggattatgtcctgcaggcagtcttcgcgcacccctcatgtcgctttcgttcctcacgaccggacagccaatgtaacggattggctggatatgaagttgtcagtgtacggcagacggcatactcccgtccttttattcaggcctgtatgaatcattttttcttttgtggattatcatatatccggtctcccacttaagagatggaccggttatacccaattctctccttccatttcgggttttcaaaaaatacccctctactatttaaaagccgaaaaataggcctactgataaccaaactttttcttaaatatatataaacttctctgaaacgcaggtattgaagcagctcttttcttccttcatgcgaatccttcagataacttcgttgggtcaacctcccctgtattcatacattcccctctcatgaataggcaatttcaatggggatggacttatgtttttctttacaattgcatggacgagccagttcctcatccctgtaccattcccttctaaaaaaacatccctctactactagtggtaaaaaataggccttctgataaccagatttcttcttacgattttcttaagatacacaagttcggtatacaaccaggcttgcagattacatttccagaaaagattcccccgcgactcatggtaaaaaacaaccctttgatagccaagattaattgcaaaaacttttcaaactaccctgaacactcctatcaattttccctttcaaaatatctgccgaaaaaatacccctcactattagtccagtttcagaccccttttgataacctcaaaaatccaatttcgttaaaagtgcacatacaactttagttatttttactcggattatcacgcctcaaatggtttatattctttccctctgtactagatattccattgggtacttcttggcgggccaccatgggccagggcatggcccaccggatagacagactccacccttggcgtggcatatatttttttgtacgggtactgcatgtatttgatttttttcgcctcgtttttcctctctaaacaaataaaaagccgccacataatatgacggctatcctcaaaacatactatcacatatcccgtatcatcttcatcaaccgtatcccatcctttaccccttcctcatacagatacagctgacacatcccatttccatccagcatgtcatcaatacaatcctctatggcatccctctgctccttggtaatttccttcatccaatggtccatccgttcgttcagcttgtggtctgctttcttttcttcctgtgtcttttcttcctgccatcgggttaccagccattctaccctggctgctatgacttcctcacattgttccctcgtagttttcttcatagacactcctccttccgccaacaccatatcgaatatcccggcggaagtccatatccacatgtcataaagattctgctccaaatacgtcagaaccacctacagggtgcacctataaatacgccattttccttgtacttgcgtggtctccagccaaaaccgaccacctgacaggtgaccaaggctccaaacaggtgcacctttgtggaagtagaaaaacacccgcattgcgggcgattgtggccgggaggggcgcctttaggtgcacctccctttaacctgcacacaaatcgaacggggaatacggtttgatttatggcgacgaatgtgacgttaagatatcaattattcttatccaaaaggggctttcttatattgggccaatttagccagtttttctgtggtatgcccatctatcccattcttctccttaaaagccaacacggcggcttacggtgcgttacaaagctctaattcatgtcatctttctaaagtatgtggatatggacttctgccaggatatccgatatggtattggcggaaggaggattgcccatgaagaaaactacgagggaacagtgtgaggaaatgatagcagttagggtagaggctctgatacgccgctggcaggaagaaaaaacacaggaagaaaggaatgcagaccacaagttgaatgagcgcattgaccattggatgaaggaaatcaccatggagcttaagcagtgttttaagcgccggggatacctggaattccacactggcatccgatagaaatttatcaacaaccggttttacagcctcttcaaacagcgctttatcaacatccacaatttcaacgccctgttccttcatctccttcatatcatcctcgttttccgctggtcagatctcattattctaagcatcagagaacttattgccggcttccagaacagcttcctgattttcagcagacaagctgtcaaaccatacctcgcttacaaatacctggtccggaatagtgaaatgttccagcagtgcaaaatgcttcgccagttcctgccatccattggcaaccactacagaggagggcaagtccgtcattggtctcctgatgcagaccggtataaatctcgcttgtacccatggcattggttgaatccgccagaatcggatcctgcatgcagcgaatcttaagtctggcaaggtctgccggggtattgaccgttttcttctggttcatcatgctgcgacttccaatgtcagtccacgcaatgatgactaatccattggcctgcgtgtccacttccagcatctcgcggaccgtcggatccattacagttccacaggcctgctatccgttttcccacagatgtggcagagagaatacagaccacatgtcattaaacgcagaacgatccgtggcatcgcactccgtcatctcaatggttccgtttaccaggccctcaaaggttgcggtcttatcccccatctgggaggacggatcgaattccatcttcatacgtccatctgagcactcttcaatcagctcccctaatttcaacgtcccctccgcctgcctaccggtggagggatacgttaccgaatactttacaagcacatgtgaagcattggcgtattttctggctttgaccactcctacatcttctttaataaatgtggatggttttcctagcggcccaacaaagtcctgaaacgagtcacaagcactcattgaagacattctcaaggtagaatcccccactatctgaaatacaatagtaaccgtgccattctctctgtcataattgcagatagtcaaagggattcgctctcctccttcatcaatcttaacaattatgaactctctcggctggcagactcttgcgactctaggtacttcaacctccatcaaataaatcttctcggcaagtttttcagctttgataattttgaacataagcatcctccgctatgtcctaaattgattctctttcacgatataatttccactggttctcaaagaagtaatcaatctcagggagtgggcgcaccggacgccattctgcgatacatacaccatttttccatgtgacttcttgaataattcctgcatgtgctccccggtcaagccggcatttatacaaatcagggagacggtaatcggattttctccctctatcatccgtatacagcgcagagcctctgctccctgctccactttgcatataatcaagcatagctgagagatacattttttgtgaaatcagcatatctcgaagccggtaaaataaaggaagctgatttacagttggtttttctattaacttcaagtagtttgtcaattcttcatttgttgtgtctaaagctattttcaaatctttgcggttacgaatcataccaccataggcactcatccgttttgccgctcttatccacatcatagaaagcgtgcaatctccaaaggcagattcgggcacttttataaactcataggcctcgttgcgcatatcattttttagaaattcgtgattatagttatccttcacgccatgcttttttctgaaatggatacattccgctgctcttaccgcgcccacctggccagcatttaatgcagtcccacctggccttgtcacgccatggctgccacaaacttctccaattgcaaacaaaccaagtatatttgtttcccaatacgcgtcagtagcaattccaccgttattatgttgtgcacagacagcaatttcaagtttatctcggaataagtcaactcgattattctgatagaattgaattgctggctcgttcatctgtttcagtctttcaatgggcgttccaaataaggcgtctgcttgtttcaaatattcgtaaacctccggtgataataagtcgaaaggaatttcccgatctcctggattttttgtaaaatctaaaaatactcttcttcctttcaaaatggtttcctgatataccaacaagtctatgacagaagagccaccatgaatcttgttcacatcaaatggccattgataacctttcaaaaaaattgcggagagcatttcctcgaagctgtcaaaataatttattaaaaattctttttcatcactaccatcggcatctgttgataagaatcttggaagaacctgcatataggtaccgctgacattccaacgcggatttaaagaagccataccaaattgccattctgtcaaattttttccttttgcgcccgcctcaaatgcgagtccactggttcccaactgtgaaacaggataagcactgtcatggtacattccggctggtcccccagttgccaggattagattcttacaccagatgagaagatatgaaggctcttccttttcgtttttatccagacaaagagccccatataagattccgtctcttactaacaagcgtattagctgcatttgattaaaaatgggaatttctttttcttttacaagcttttctaaacattccgtcatgagtttggaagtataagggccagcgctggtggcccgccttcctctgtcatgatctgttttataccccataaattcaccatacatggtgttaggaaaaggaacgcctgattccacaagccgtaaaaaacttctgacagataatgccgcctcacacagcgcctgatctccatccacgcactgtcctgcaaacaaatcttctgccattgtgcgcacagagtctaaatccccgctggccagcgacagcttataataggtctgtttatctgagccggtatttctggatgttcccgcattgatgttttccgctaccacagcaagatctgtttcaccgttttgatacaaccgcagcgcggcttgcaagccagccgccccggttcctacaacaatattttctatactaagctcattaattttcatattctctccttacagtcgcctgatatgaaatcccccatctacatccacatggtttccagtcgtgtaaagaactttatccgagcagaacaggcttaccatattggcaacatcttccgctttcccccaacgggcaagcggaaacacaccgtcagcaatcatcttgtcatatttttcggtcacaacgctcgtcatatccgttgcgattacgcctggacgaacttcattcacaatgattccctcggatgccagcctgtctgcatatagtgtggttagcatggaaacagccgcctttgaaatacagtattctcctctggaagtggaagaaaccgtcgcggaacaggaccctacatttacaatatgtcctttacacgcaaatacctgttcttgatgaatcatctggtttgctacaagctgcgtcaggaatagagtacccttggtattgatacccacaactctgtcaaagctttcctcagtcatttcaaggagatcccttctttcttttggcgccacccctgcattattaatcagaatatcaattcggccaaaatgctccaacgtttcttttacaagcatttccctgcttttcggattatcaatagagccctgcacataatgacagtccagcccaagttcagttagcccatccagtgcttcttgatatgtttctttcctgcctgtggcaaaaatcactacctggcatccatcctgtccgagttgctttgcaattgcatatccgattccacggcttccgcctgttacaatggctgtctttttcatcatgccatcccatcctttctatcatcagcccctaaaattagccggctgcgtctttttaatctcctgaaattctctataaaatggcataaatgtttccgaatcccttacaatacatcctgtcggcttgtgagccctgattaaatctccacactttccgcaggtcacgcagactctcttcggattaatacggccatcttttacaatttcatttgcaaaatccggatcggcaaaggacattctcccaaatagcattccatcacaatatccttcttccacagcccctgctgtaaataagtctgaatactgtctcaaataagttggagccgaaccgtagataaccatctccggaaccgctcttttgacttccccaataccgtggatcattcttccgattccaacaagcgggtgctcatccggaatatattttcccatatcataagggcgggtgacatgagttgtcgcatagggattccccattgtaaggtcaatcatggacagaccctcctcatgcaattcctttacaagtctaataggctctgtataattgggggtgacgcctgattcttcacttactccaaaaccgtatggatatgcgtagccatcatagattcccagcctggccgtaatctggaatcctttatcctcataagcctttgccgccctaatgctatttttcagaagtctggtacggttctcatagcttcctccgtaaatccccggacgattgtaagcagaagataattccgcaagcagatatccatgacaggatttgatatccactgcatcaaatcctgcttccttagccagctttgatgcctctccaaatttttcctccaatcctttcagataatcatctgtaacgatacaggagtcatcagctactctatattgctccagttccggatgacgatacgcaatcattggcgccggtctgttatccggattagaataacggccactgtggttggcctgcatgattagatagggagcgaacccatttgcctttatgccagcctctttgattgtattggtaaaaaccttatattgttccaaattttctttggtcaggagcaactgtgttttggaagaacggccctcctccacaatagaaatggcctcaaaccaaatgatggcgcttccaccaattgcctcttttacataacggcgcagagtaaaatcggaaggtgaaccatccggcaaagcgtccgccccctccataggcgcaattccaagacggttgcataatgtaatgttacctatatgtaatggcgttgcgagtatatgtgtatctgcagcaaatggaagatacacatttagctcctgcgccttatccaaaacatcatttaatgttctgtaatgaaatttttcatgtgccatgttagttttctcctatttttggattaactttatttgagtcccggttctccatctccgaaagacggaatcttcttggagaaaaaccagtatactttttgaattgttttgaaaaatgagtaaaatctgtatatccacatttcacagcaatatctgaaacactctcattcgtttccatcagaagcgcctttgcacggctcatccgcagagaattcatatagtacattgggctgtatcctgtttcatctttgaaaacatgtgcaacgtaatttttattcagaaataatgcggttgatatactgtcgagggagacatcttctgtgtaatggtgctctaaataatttatcactttatatgcaatctccgatgcagagctcattttcattgttgataacacatctgcacattctctgaaaatcgtaataaacatcttccgcaaatcagcgcccacatacatttcccagtaggcgcgttttcccagatactcccgttccatctcaacaattaactcataaatataattccaggcaggctctgccaatgtaagaagatgggaaaagtctgcgggacggcgggtaaacacagaaattatctccggatatttcacttcattttgaaaaaaggttggagaaatctgaaaaatgtaacgctcatagggataatccaacaccttcagcgtatgttcttccagtgtgttcaatatgataaagcctccctttgtgacttcgtactctttatcacccacctgatacatgattcttcccgaaagaagaaacagcacctgatatgtatattcataatgatgatgaagctgatagttacaagaatcataccgatgcttaatccagaaatcctccataaccttttcctccataaaatctgtcttttaaattatagtagcacagacttgttttccactatagcataatattgaaaaaaatcgttgccagcagaacattcgctaaaattgcaaatggctgtgctgctccataacctgtagtcggatcttcggaaccagtagaactgattgcagccccaagccctggtgctgatgtacagccgccggcaattgcgccgcttaaaataatccagttcagtccaaataacttatgaccgataataaagctgactaaaacagcaactgcttctacaaaaatcgcggaaaccgctagagccagaccagaacccatcaaagacgtcaccacatcatatccataacgtaatcctacaacagccataaaaaaggtcagccccatctggtacataattccaagggattttgactccatcctgaaattcaccggtccaatcttaccgatatagcttaaaattaaagcggcaagcaacacaccacccgctgtaccaagtgaaaaacttccaagacttcccaatggaatcgtaattccgcctacaataattcctattactgcgacaagagatataatcataaaattaagcggttgttccttacctgtttcactccctccagcctctcggatttctttctggtatgcctctttctctttttccaaatctatacggaatattttaggaagaactgatatcatcacaacaatgaccaaaactcccatagggaaagccacggtatatcccagactgattgaggaggatgcttcttccttataaattgcaatctgctcatcggtcaggtttgccgtattttctattgttaaagctccggttggatcaatcttctcaagaatctttcctctgtcttccattgaggattcttcatatagttttacataatctatattgcccgctgcgtccaatgccgtcccatatccaggtgtcgttgtcatggaacccgcatacatgccaatcgtttcaaacggtgtaatagattggtttgaagacaaaacagtactataaaggatacaggcaacggccatagatacaatcggaattgagactccgataataacaaattttataccatattttttgaatatcattccaatactgtttcccactttaagtccaatggaaactaagaacagcagaagaaaaaatgtgaaaaacgcttgtgccacaacaccggtggaaagaatccttttggcatttgcataaccaatcgctccttcctgagctgtatgggcccacttcgtaacaaaatatccgataacgataccagtgaaaatgccgccggaaactccaagtgaaaaacttttaatctttattttcccaatcaaaagtcctgttgcgattgccaaaaacattaggaaaaactgatttgttaaaatggtatttacaaacttcaacatcgtaatcccctcctggtctatttatacgtgaaagattcgttctgcatttccgaaaagaattgcctttttttcttcttccgataaagcaaggctgtcaatagcttttaatgtccggtcaatatatcccggacctttttccggatcaaacggcatatcagaagcaaatagaatatgatctttaccaaaaaagtcaataccacagcggattgcagacgccgacccaaaggatgccgagtccgcataaaatttcttgaacgtatcaatagggtgacctttcagtttcgttctggtaagcttctcttttaactcgggagctgtcctgcctccatacattttaagaccgttctcaattcttccttccagcatgggaatcattgccccaacatgatgagttactatttttaaattcggaaaatcttcaaatataccggcaaatgccagtcggcacatggcaactgttgtttgatagggccagcctatgagaaaccacagttcatattttgagcaatcttccgtgggatactccggcgaagtctgtccgcccactggatgaatcagaaccggaagctccagcttttcacatatttcgtaaattggccagaatttttcctgatcgattgcctccccattcatatgggtataaatctgaaccccttttgctcccattgccttgcatctcttgatttcctcaacagaggcagacgtattattaaacggaatccctgcaataaacccatcataataatccggatgttcttccgtaatctttttaatctcatcatttcctatcgccgcaatctttggtgacttatccggacctgcgaataattcaacaggcggtgaaacaatgttgggaatctgtttgtatccgggaaattgcttcaaaacattaagacggtactccatatcagacattgcctgcatttttaacgccctgacaaacatatgtgacttgtttggtgattcattcatcgctaattccgcatacttttgtggcatcaggtgacagaacacatcaattgatttcatattgaaatcctccttcagaattgttgaaccggataacatttggccaattgttattacaaagctttctttgtgttttgataataacatttattcttcatatattcccgtacaatcctgctttaaaaatggcttatattgttatttttgctcgtttttaatgataatcaatgatgaatttgtgtgtttagcataattttctatgaagattgtacaatatacttttgttacaataaaatataaagtcaaatcaaaaaggtgtatgaaccacattcaactttttgagaagacctactgttagttcatacacctacctaaaaattacattttgagtattcaacaaagatattattccttttaatctaaatcgttgccatttgaattaataacctttttataccagtaaagaggcagttatgattctagcatggtttatcatgcacagtgcggcgccgctttccggcagactgcaaaagctattagataaatgttggttgtgcttcgtgaaaatatataccggcgtccaggttgtcccggcatttaacagtgaaacacggaaccaggagcgaatgaatgaaacatttcagaattatgcaggaacttccatctagtcgaaccggtggtttgcgtgtctggacggactttcccttttcttcatcaaccttttcaccgtgactgtgtattggttaagcggagcggaaatcagcatacctgcaaatcggtgctttatgcagcgcttcaatccccagaaaagcaaagggaatcgcctttcgctcatctccgaaatctaactgataaatctggaaatctttataagccaaaaaccctggaagaatccatctcccagggccaaggcatctatttctcacgccctgaaaaacacccattttcaggccgcaaatccactcaattttccctcaaaaaccactatatcttgtggttttatccttcatttttctccaaaaccacaatttggcatctaaactaccgcagcttaatgcctatgcatcgaaaactcatccataggatacttcttcagattttccagcacatgcctctcctcggcagacccaatcagctgttccctggccttcttggcctcggtctcagttttatgccggctgggaccacccacacagccgcctacacaggccatgccttccacgaaatcttcaggcagctttcccaccttcatgagcagcaatgccttcttacactctgcggctccgttgcagcgggctactttgacatctgtgttttcgtccatttccttcaggcattccagtacggccgctgtcacgccgccgccgttgccaaaacgctttccaaacacagagctttcctgataatcattctcggccggctgaagctctactcccttggcgcgcatcatagctcttatctcaccaaaggtcatggcatagtctgcatttccctttacattcaaatccaggctctcgctcttcttggctatgcaggggccgatgaatacagtgactgtatccggatccccgctctttatcattctggacactgcgcacataggcgataccgtagtggacatattctccagtaacattggaaaatgctgcttaatcatgttcacaaacgcaggacagcaggaggtagtcatcttctttccctccttatgggcctgggcccattcctctgcctcataggcagcggtcatgtctccgcccaatcccacttctatcatgtccgcaaatcccagctgctttaatgcaattttccagctggccatggtaatgtcagggccgaactgcccctctgtggcaggcgccaccatggcaaccacccgttttcctgccttaatcagacgaatcacatctaccatgaaggtcttggaccctatggctccgaacggacagctatggatgcaggctccgcactggatacatttcttctcatcaatcacgcagatgccgtactcatcataagtgatggcatccaccggacaaattttcttacacggacgctccagatgggcaatggcgttatagggacaggcctgtgagcacttgccgcattccttacatttgccgggctcgatataggcccgctcacgtcccatgctgatggctccgaaattacaggagttctggcaggcctttcccatacatttacggcagttgtcagttactatgtaggatgcaatgggacactcctcacaggccgcattaatgacctggaccacattggatgtgtccttcccggttggacattttccttctgccaggcggaccctctgccggataatctccctttccttataaatacagcagcggtaaatcgcctgaggccccggtatcatggaatatggaatctgctcccgcttttcgtccagattcccttcccatgcagctttagccacctcgtaaagtacatcgtgtttcaaacgcaggattgtcgcatcattggttaccattttttctcctccttgttacgggcacttggagaccgtcctatggtctcctgcgcaatacatatcattggcttatgccatatatgtctgcttttatatcacaatttgagtttgttaaaattatatcaacattagaaatctactatatttaccctgaaaatgcaagtattaaatggcgtacaacattagtaatatgtcaccactaccgtctttcccatctcctcaatcacatgcctcagctgttctaccagattctggcggatacccaggtcaaagggaagccccggattctggtatgcactgttgattgccttccccacatacaagtgcacctccgtgcagtcttctatgagcaccttggccaccatggaacccccgttgggcttatccagttcatgaaaaaattcttcggatacagtctcatttttcacatacctgcgaagcagctgaagtacccggttaagggtaagaactccctctgtaaccaaatccacaccttccatgtatgcgatgggaggtatctccggatccacataatccagtgatacatccagtttcttccccagcaccctggacacaatagtggcactggttcccccgcagacaatggtcttggcattgggatcatccataaaatcctggaccatacggacgtcgtcttccggattcctggcaggtccggtcataaggtgaaccggtttgctgtcaataatccgcatacatgccaccgtggtatcatccccggggcggaactgatacagttcatcacaggccctgctgatgctggcggccagacgcatggccgatacggtcagaggatactgtctcaccgcgtagtccgcaatgtcctgccacagccatccaaagttcagcagttcccccacccctgcatggatggtgccgtcgctcatgagaatcagggcatcgccttttttgaccttgaatctgtattcattgatttccttgccctgcatgacccgtacatttttcggaatctccataagctttccgtcccggataaaaatgcatccgggattatcatattccaccagatacgcatccccattatgatatacctgcagtatgctgaaggtggaataagccacctgcctgacctgacagatggggagagtctcactgatggtatccacacactcctccagggtagccccattgaggaacatggttcccaatatcttagaggtcagcgtggacaggatattggccttgactccgcttcccataccgtccgccagaatcataatgttggaatcctcggtctgcaaaagctctaccttgtccccgcacaggatttcggtgtacttgttcaggcttttatatgcaacatccactgtaattcccattatttacctccgctgccgcctggtttctttaaatccacattgctcagatggacataaccggattttccgccgcccggattggcgctgcctatatggacatagcccgtaggctttttctgctccccggcattgtctgccggatttccggctccgggtatctgaccggctcccgctccatcagacgctgcgcccgccgccccggctgtcatgacgccctttaagggcacggctccgcttcccagctgtacgcccggaatttcccgctccctttctcctccggcatacccggcatcgctgccgtcctccagcaaggagtggcacagcttggtcagggtggtttttgtctcagctgttgtctctcccagcagacctgctatctcctgagccaccatcatctgcttgtggatgactttctgggccagatctatggtttccagctttctctcatattcttcctgggccagctcctcctcacgggttatgtctataaaggtggccaggactgcattttccttttctatgtacacaatgttctgcagggtggaaagattatattccggataattcacccgcttgccatggatgttctggtgtgtgtcaaatacccactggaagttcaccgggtcgataagttcatacagatacatctgcaatgcctgggaacgggtccttccaaaatatctctcgcccacatccgagtactccataatgcgcatgtcatctcccacaatcagtacgatgttgggtgaagtctccatcaccagattagccatggattccgccttttcatgcataaagggaatacacatgctcacctctgccttgtgctggaatacggcaatggccttttcccggcaggtagggtaaccgcaggcgccgcagttcagctcgtcctccggcttcagcttgttggtcattcgcaggatttcccgtatctgttcctccgtaggctgggggtctctgggggaatggtcctcgaagtgctttctgaagttcacattttcccacaccggctccatctgcttttcctcagccggctccctgcagatgctctcctccatgtccagcttgaccttgaatctggaaatgaactcctcatccaccgtagggcctttaatgcagcctccggaacacatattcatctctatgaaacagcccttgatttcaccacgggacatacttttacacaaatcaatacaattgtcctccccgtggacatagaacttcctgtatccgtcccccttctcctcggtagccagcacagaattgaccacgccgttggtcacgggatacaggcggtttacctttgggtcaaatgcggtaaatggccggtcttcacagtcctcgattacgatgtcctcttcctccagccatttgtttatatcattgaaatttaatacagcgtcaatatagccctcatgcctcagatccattgcctcttttttcttggcaatacacggtcccaaaaacaccacctttacatcacgtcccagttcttccttcagaagctttccgtgggcaatcatgggagacaccaccggtgccaggtaaggtataagctgcggatagtagatttccaccaggtcattggcgcttggacagcatgtggttatgatgttctccatcttgtgctctgccagaagcctggcatactcggccgtcacaaaagcagctccctcagaagtttcccttacatcctcaaatcccaggcgcagcagagctccccgcacctgaccgattgtcttgtatttcaataaccccatataggacggtgcaatagacaccaccacgcgcatgccttcacgcaaaaatccgcggaccatgttcaggtcactcttaagggtttttgctgactgggggcagatcttcagacagtgtccgcacaggatgcacttgtccggcataatgaccgcccgctcgtccttgacctggatggcctttaccccacagtaacggacgcatttatagcagtgtttgcactttgtggctttgaaatctatgatttccatgcccataatcaaagtctccccttaatctcattttcaaaaaattcttctgtatcttccggcttcagggaatacagctcgccctccaccgtcacgcacactccatggtcacaattgccggaacagaacgcaccgtttaaatccaccttatcagacaggccgttctcatctaccagcttctggagcttactgataatttccctggatccctttaaatgacaggcgcttccaatacatatcgttactttcatcccttattcctccactatctgcgtgtattatgggctcaccccaaaccatggcttcattatctcacattgtgatatttatatcaataatatttctcaaatattttatagaaaagacaggcctgttgtgctatagttaatgatatttacgagaggagttgaagtattatgaaaaaacaagtttccttacttttaatggcgtttatgggtgtctgcctggtgctgggcggatgcggcaggagcacctcaggcacatccgtcacagagactcagacggaatccgggacacagacggaatcccaggccgacgcacagaccataaaccagaacggtgaaaaagcctcccgggaccaggtctcagaaagcgcttccggcgcagcgtcctcccctgaatccggttccgtcgatgaactgaacacgggttttgatgaaaacaagctgacctgtcaggcagccatccgtgtaggctctctaaagggccccacctccatgggacttgtatccctcatggacaaggctttaaagggcgaaacttccaatgtttatgaattcaccatggccggcaaggcggatgaactggtgggcaagattgcaaacggcgacctggatattgccctgctgcctgccaatgttgccagtgtgctctataccaagacccagggaaacatcacggtcctggatattaacaccctgggcgtcctctatgtggtggcttcagatgacgccattacttctatggccgacttaaagggacgcaccatttacatgacaggaaagggtaccacccctgaatacgtaatgaattacctgttaaaggaaaatggcctttctgcatctgatgtaaacctgcagttcaagtccgaggccactgaggtggcatccctgttaaagcaggattccagtgccatcggtgttctgcctcagccttttgccactgctgcctgcattcagaacccggatttaaaaacagtgctggatttaacggaacagtggaacatgctgaacaaggacacaggaagcatgctggtgacaggcgttaccctggtacgcagcgattttctcagggagaaccgttcccctgttgcagacttcataaaggaccatgaggcctccactctttttaccacggaacatccggatgctgctgctgagctgattgccagtcagggtatcgtggaaaaagcccccattgcccagaaagcccttccctactgcaatatcgtatgtctgaccgggcaggagatgaaagatgcattgagcggctacctctccaccttaaatgagcaggatcccaaatccatcggcggacagatgcccggagatgatttttactatatgccataatcttgattgcggagacattcctcatgaatcaacctacaaatcacaactcaggaatacgaaaatatctggtttggctgttctggattgcagtttggcaggcagccaatctcctgattcacaacaacatcatattcgtaggccctctggatatgattaaggctctggcagaacaagcggcggatccttccttctggaccaccatcctgaattcctttgccagaatcagtcttggttttctgggggcctttttcttaagcatccttctgggaagcctggcttatctcttccccctggtaaaggaactgctggatcccgtcatgcttctgattaagtccgtccccgttgcctctttcgtcatcctggcactgatatggataggatcccgcaacctggcagtgttcacctcctttctggtggtagtacccatggtctatgtaagcacactgtccgggctggagcacacggataaaaaacttctggagatggcccgggtcttctccatacccatgtggaaacggatccattacatctatgttccggctctcctgccataccttgtaaacggatgccggacagcccttggtatgagctggaaatccggcgtggccgcagaagttatcggcataccggaaggttccatcggagaacagctgtactactccaagctgtatcttgacacggccggactctttgcctggacctttgtcatcatagtaatcagcgcattgtttgagcgtttctttctttatctgttgaagaaaataaagcattaaggagcgtgtatggaatgaccctggaattacaaaatatatctaaatcatttgacggactgcccgtattaaggaacctgaacctgtcctttcatcagggacaatgctattgtcttatgagtccatccggttcaggcaaaaccactctgctgcgtatactcatgggactggagcagccggaccagggcatggtgcttgcaggcggaaaacctcaggacatgaattccctgactgtttccgctgtttttcaggaggacaggctctgcgaatccttttcccctattgaaaatgtatccatgtgtgccggccggtctatcaaaacgccccgcatcaaatgggaactggcccgcctgcttccggaggaatgcctgaaccgccctgtgtccaccttaagcggcggcatgaagcgccgtgtagctgtcatacgggcccttcttaccccctcccgcatccttctcatggatgagccctttaccggtatggatgatgaattgaaacggaatgtcatttcatatatcagggaaaaacaggacgggcggcttttaatcctctcaacacatcaggaggaggatgtggaactcataggcggagagctggtgagattggaacgctgtatggacgtatgatatgtttgatatattcgtataatcaaaaaaggcgctgcagcctctggttttactgagcccgcagcgcctttcatatatgatatagaatataattcgtatcaacagactataccgtcacccgtaccggtacagacaaaatgatcctacatctgtctcatctggtcctggcaggatggcgcctgcatatcgaaggcaggattgaacgcatagaaattcctgctgtccagtttctcctgggtgatacgcagcagttcaccgaatctctgataatgaacaacttccctttccctcaggaatttgatgggttcacagacatcataatccttgacaacgcgcaggatattgtcataggtgctcctggctttctgctctgcggccatatcctcatgaaggtccgtaattacgtctcccttggactggaactcacaagcattaaaaggaatccctcctgctgcctggggccagataccggtggtgtgatcgatatagtaaggtccgaagccctgttctaccagctggtctgcagtcagtccctttgtcagctgatggataatggcggccacgatttccagatgcgcaagctcctccgtaccaatgtcggtcagggttcccttgcactctttatatggcatggcgtagcgctgggaaagataacgcatggaggcacccatttcgccgtccggcccaccggatgtcaataacatatgattagattaagcccctggaatcatggttccggaggcttttctggttttattatagcatggatggaaggcaatgtcagtatgtttttggaaatctatttgaaccaggccctatggatgccggtctgcaccaaaagaatcattccccatttattttcccgcattttatgataccttttgtaactttttgttgtcccccttcccttgatagtcctcctcctaatagttacttttataatgtaataagttttaggagggctaacatgaaatacgaaagagaaaccagtaacctgcttcgacggcttggcgtcaataattcctacataggatttcgctatactatctatggtgtaatccgctcagttcatgaaccggacctgctttcctatatatcaaaaggattatacgtagaaattgcggttcggtataaaacatctgtgggatgtgtagaacgcaatatacgcaccatcattaatactatttggctccatggagaccggaatcttttaaaccaggttttcggctttgaattggcacaaaagccgcggaacggcgcctttattgatgcgctggctcattatgttgtacgccattattatgattgaggaagttagggcgctatcgcagcgcccttcggtaatctaccaattaaacacataccgacgatttgccatgtcgtattcttctgcaatccggagcacacccctggcatccgtaatcatgcacttgccctcgtcgctgcccttgactggacaaagtaaaaatgcctcaccggcagggtccacctggtagccggtcagcatgtagccctcggaatcgaacagataccaaccacaagtgccgtccgtggcctcccggagccagtaccagccattggccgcatagctgccgtctgtaaactgataccaccagcgctggccgtctgcggccggctgaaagccctgggtgtatgtcactgggaccggggtataatcaatatccctcagtttaagcaccttctgccagggcgtggccgctactctggacttgatagtcccgtaattgatgcccttggcctcgatgcaccagccatccccgatatacaccccgatgtggcctggcttccagagcgcccaaccgaccatggactcgtccaaatggtcaatgcctacccgctccacggctgtgtcatggtagttgtaactgccgcggatgcgcccggtgtaccagctgatgaggccggaacagtccgtgcagcgctggcctatgtacttggccgccttggctttgtaggtggatgtgtatgtgcctgggttctcccgggccaggcggtcaaggatggcctgggtaatgacctcacccttggcgccgtaaacgtagggtgtgcccagcttgtccttgcagtgctgtattaatccttctgctgttttactcatagtgttttcctccaatcaaaaaaataaggcccaggggcatccctgagccatgaaagaacgccccctctcacaaaggacgccctcattcataaattttatttttcaaccagttttggctttaatttgtataacgaataaactacatctacaatctttccttccattctaaataacatatacttcattctttcaagattttcttccctttgatatgtattatacatttcaagaacaatctccatgcctgtaagatattttttcatatctttaattagtttttgagcttcctcattctcaggtatgtttaccaccactcttttagtcgaactaatgctgttaatatcagactttttacttggcgtaatcggaacgacttctttattctctgatttctccttcacccgaaagtaatagtccaccaagtaatcgtacacctcccacgccttgtcagtgtttagggacttggcatggagaagagcgcctttttctgtccagagatagagggatttagcatattttagggacatttgattttcacatgtcgttttcaatctccttaattcatcacctgttacctcaatataatgttttccgagtatgtatcgatccttgttgtaattaaaattatagattatcttgtctttcgttactccataagcttctgctatctgctttgttgtaaggacacgaattcctgttacttctaaaatatccaatttttgtttttgcataataaaactcctttcaaattttggttattgaaagaagtttcaccaactgatataatatatttatcagatgggaaacctctggtgcaaaagtagtagttgccggtcgccaaactagccaactgctacttttttaattcctcattaattttttggtcaagccattccttttttgttttattctgtttagctaattctttctcaaaagcttccatcgtatccttttcaacttcaacgtgaaatgccttttttccttttcttctttctctgaaataatctgacctgttttttactgtctgaggaattaacacaaactcttttttttcagctatcttattcacctccttgttgcatgtaacaaatatatcatgttgcatgcaacaagtcaagatgtgtttttaattctttctatcctatcaagagaaaaccaggggcatccctgagccatgaaaagttgtgacgtcacaagttgcgatatcgcaacaaattactccatacccggtccgtgttccgggtcctggtcggaattgtgcttcggggtgttgcttggctgccacttctccttatcgtctgtaggcttcgggtcgtgtgccctcgggtcctccctgccagtccccgggccatagggcgctttatgggagcactccgtcaatggacgcttattagtcatcggattgttgtttacatggtcattcagctgctgctctgtcatttttacttctggcataatcttactctccttctatgcaatggtaaatggttactactgtttaagctgcttgacagcctggttaatcccggtcgcagccaatccggatacaattccaatggccaccgcattgataacatcctgggccgggaagtccggcatggtatacattcctaccactcccaaggctgcccctgccactccgcatactaccgggataacctcgttcctaagtctggcgaatgctttgcaggccatcccggccagatagcatatcactgtaatccctgccacactcgctattccaaaatccatatcctactcctctctttctgccggctcctccggcatcttcataagtttgtccttaagctctgttgccacatcattgccgcccaggacatggtatgcgtcatacatccgcttaacattttctttgccatatatagggcagtaacccctgtcctgataatgattgtaggcctgtatgatacggtccctcaaaagtgcctgcataccatcgtgaagtgcggcattttttcggctctcctccttctgccgttttgccatctgccggtaacataagcctaaaaaggtggatatggccacaaacagccactccacccaatggacaactatgtactgtattatctcgcccatgatgtctccttactcagtaatcagttcttcacactccaggtcaaccagtacctggcgcacctggtccttaattttatccgggacctgtccgaatgttttcctccccttcacaatcagggtcgcatagatgactgccatggtatccacctccttcctcaataataaaaagagcagcagcctaagcattgagtactgcctcgacttccacccttaacttctccgggacctgttcaatcgtcttcttgcccttgcgaataaggtccgcatatacaattaccatataacttgccattccttacacctccattccctcgtaaatttctgtcagggccagctgggtattggttacctcttcggccagtgctagattggcctcatactgttctgtgagtgccaactgtgcctctgtaagctggtcacccagacttaccacctgttcctgcagacgtccaatatctgactcaggcagatacgcaaagaccggctgtggattgccggcatttgtcacatcaatatggtccagtctcgcaccatctgggatatctacccagatgcactgcaggccttgtggtacctgttcctcgccatacataatagtccaaatacggccggtgtcgtcatagattactaatgctttcatgtttcatcaatcctttctttgtgatatactgtttatcaatgatggtttcaagtataggtatgttttctatcttgcgatactattgtttatgggaagcctgttttaagagccataatattgtttatgggaagagcatttttggcgtttccggaaatgtgcggaagtatgcgagtataactaaaacccttacatcatctaccagtaaagtcaattttacgggaggtgattgctccatatacgcttattatgtgagtattagcaatattggcttcacacctctctatgcatcaattgtaggagaacacgctgattacacccctattcatggaggaggagatggatgggggtttgcttatgctgaaagaagcaacagaagtagttatggaacccaatttttatattggcttaatggtggatactattccttaaactccggcttggtaagactcccagcgggatcaataaacgggggaagaaatatgacagttaaagtatttggttactattaataatatccggcaacacagtaccagacagtaccattttcaatacatggtaagacagcattggtactatttacatgccaggcaccactcatattaaaatcaaatcggtaattccatccagcacagtgggcaggattgcctgaccaaaatcccactagggcaccatctgtccaggcaatgcacgatacattaaaccctgttggtattgtcgccttatacattgaccttccaggatcatatccagcactgatagagatgcttgcagtacctgaggatgatacagtactgtttttcacggcatacttccggacattgccggccaccccaaatatagacttcccataaacaatattatttgcatttagatttccgtcccccttaatagtctgtgctccggccaggaactgattagccgcaataacctggttagatgtcccaggcgtgtaagtcttggcggctatttccgccatgattcccgtcaatggatttccgtctttatctacgatcactttccctttgcgtacatccgatgacgctgctgttatcacatccaggtcagcgccatcaccgcccccaggtatccatatcttacccattactgctcctttccaataccgccagtatctcgaccttctcgccttttgtcaggttcctgtaaccttccaggatgtctgccggctcctctccttgattcttccttattctgagccccttaataactatcgctttaaatatttcattcatcacactgcacctccaatgatatctgccatagccactgtaagttgggcattatctgcccttagctgctggatctcttccttgtcagttggcaatctgtcaattactgtaacaccatcagccttaaagaatacaccattaatatacttgtcattcctctcacaaacgtactgcatgcaatcaacggcaaatgcagtatcaccatatacaatccttgcaaccctgtttgcatcttcatagctatatgcaacacaaacatccctgattgtttcatcatgcaccaatgcatatacttcatgtgctaccataatttacatcctccttacttaatatagtcttaacaatattactcctgaaccaccgtatccaactggtccacagtatggtctatatgattggtcaccatatggtctattctggccgccgccgcctccaccagtacctgctccaccattagtagctggatttcctccgccgccagcccctccagctccgccataataaccggtccaatagtgtccttctgatgaactaccactttgccagtacccactaccggaaccaccaccaccagaatatagtgtattaccagcttcaccaaatgctcttgtggttctaccctgaccagtaccaggatttaatgtttgtgatgcatattctccagttcctcctccaggtctaccattcccaccgtcttgtccaccactaccaccatttcgataggcatacccccatgcgtcaccgtctccgccaccgccggaacctccatttcctccctgcactcttgaggcgccaaccactataccagactgtccgccaccagcagtgcagatatttccaaatgaagttgcagcgcaagcaccacctacagtagcggctatttgttgtccaggagttacatgtacacctttggcagtatttgtatacccaccaccgcctccagctccgccatgtaatgggtttgttgatgaaagatttcttgatacttcactgccattacctccacccccaacacagaatacgtcaatagtgctgaatccatctggtattgtatatacctgtgtaccagtaattgtaatattttgcactccaccagtggctacggttgcttgcttgatagatgctgggtcatataccggactccatatatctccaaagcttgttgttgcatatccaaaacatgtaaagtaatataaggtattgagatttggcatatccataaatacctgtgaccaaccacccggagctgtattactaccaactccagcatatcccgcggcaaggttggcatcaggttcattccatgctggatatctgcctgccatacatttaacgataaccccaccaaatggtttccctggagtggggtttggattctgccattttactaatacgcgccgcccagaatacggcgctacactaaaagacattatactgttgactgtcattcgccctgtgccaggctcgtcattactgtccgatgtgaccgcagtctccccagccagtacatggtccagcgtggctgtgcactcgtcacttccacttccgcctccgctcccgcctgtcatcaatatttcacccatttgtctttacactcctttcaggcctacggtcatatcaatcgtgggcttcttattgtagcatttaaatgttgcctgcccatctgccgtgtccccatcgtcaatcattccaaatgccttgttatacgctttcacctgttccggcgttgccccgtctgcaatcacctttaccagtatggggttgtcctccgttgtcagcccctctatcggcacagtctgggtatatggggcttcagcagaccagtccgaggccagaatagagaccgggatgattattcctgcccgttcagtcctcttttttaaatagttatcattatccaacaacttctgataccgtgggttgaatgtatctggcgccccacggtcctgatttgttatctgcgccatcgtcccagaaaattccggggcttcagtgattgggaaatctgccatcctgcacctcctttaaaatacctcgtccatatcaaaaatgaactccatgtcatcatccttgccttttggcaggaacgtcttatatgcaatcaggtcaccgtctgaatcaaataatccctgttcggatatattctgattagccagctccgctttacccaaacgtaccgtgtatcggcaggtggtctccttatcatccgtatagctgtggctgccgatatccttcttaagcagttccgccttaagtgccgtctcagttccggttggctcaataacattcccatccgcatccacaccaccagacccaaaggccatctgggtgattgctggcagtgtctggtcccctgcatgtgacctacacagtttcttgcgtcctatctctgtgattactccttgtgccatattgtcttaccatcctttcatagttcatattcaaaaatctctgcgtctaataatttggttccattcagcaggtaagtcccatcaagataccataagtcgttctcgacagtcagcttgcaaatcatctcaggcccggtagatacctgctgtaatatcccggacacggaaaccatggaggcatttacctcttcgtcactgtgtagcgtcagtacttcctgcatttttgggtacactgtcgcgtcagtttgacaggcagtccgcacctctgtatctactgagactgccgtgtatcctctgagccattgctgcactcccactctggtccctgccagcatggacgatcgcagcagtaatgcagtgtggacctttatctcctcaaatacttctgatatcataccaactgctctgccatctactacattcctggccgataggttaccccttattaacatcccaaatggatacaggtccagtcccgctgtcttcttgtacccattgagtaaataagtcccgtccaatttccacgttccatccaagtacaagaactcacggttatatcgggcatagaaattggaggtcaattccaacctacctgatgtagctgtattgactggtatctctatcggatataaaccagcaaaaataaacaacagattggctggtatcatctgccgtgtcatatcccgaagttcctgtaatacgcgacatggctgatcaacaatccacaactccaactcatacgtcttgtcgctcactcgtaatatgtacccatcgttccccacgattaccgccaggcgctccttaaggcggggaagtgtatagggaagctgttggtcccatttgagcgaaactgctgacctgcgttcttccagcgtgtctccagaatatggttttagacccaacatcagctcatatcgcttaatcccttgaattgtggcatcaggaattaggctgtccttccatagcgaatccaggtctccatacagccgtttcaattcaccttcctgcgccccatagagttgtctgaattcctttacttcccgcaggaaatccgggacatacctggctaaatccagtatccggcctggctgccccctcttatcatccacttatatccccccttatcgcgattgaaccggaagagagtacatgattaccgggacttccattaatctttgtatcatagacatccacgataccttcgatatccaacaggcgtccctcaattcgtgacaccctcacaactgtctgaacatcatcctgccaagccatgttcagttcatgaaaatatgcatcaattgcctggaaaatatcctctctgcatctctcaaagctgtagcccgcctgatagacaatattggacataaaggaaattcgctcctctaccgctccttctacggtaaccgtgtggccaatgggtgccaggccatatcctgcacctgtattcgaatctggatcaattacatcctttaccgcctgaattagttcattcgacgggattccatattccgagttaatgattaccagcttaacggtccctcctccatcccaggccggatacaccttgacacctcccacgccagaaatgccattcaccttttcacgataatccgctatatttccaccaaatgcctgtgaatgcagactatcaaaataacggtgccggaactgttccgtcccttcctcgtcctctcccggaatcagcaattctgttagttctgcctgtgacagccctctgatatactcaatcggtatgagtgtcccaaacagcgtgttccctgctgtacctatagtctcacactgcattttatactgccccttagcaatacgttcgactgccacatagttcaatgtctccaacgaaaaacgactgccaatgggaatatccaagtcaaattcaccttttagtactgcatatgtggcctctttcggatgcaagccacgctctaatgctcgcttgattaaatactcacggctagccgtatccgcgaacaattcattcaacactgcatgcaattctgtgtacatcaattggatttccaccgcggctggagccaatgcatcatagacgattgacccttcccttttgtcaacatcacttggaacacggtccagcatacgcttcaagatttcctcatatgttacgtcttcatacatttactgacacctccttttcaactgcaaacactcccgcatcactggaaacggtaaaggttacgatgacttgatttttatatcgtgtaaaagaaaaagccccgacacttcgtattcggtcgtcctgaatcaatgcttccttaatccgctttttaatcttagactccaacacgcccattgacccgccatacaagtctgcaaactccctaccataattccagctgtaaacgatgtgttcaaaccgctccgtgttcagaatacagaatacggactgctttacagcctctattccctccacattccctatcacccttccatccttcaacctatatgtctttgacggctgttttcggatagtaaaatccgctcttaaaatatctcctgtctttggcagcatcacgcacctccttcctaataccggtctatcacaaggtactgctgcgcccctcgtttctgtaccaatataaccgcctctccggctttcaaggcattcttcaccgcaaccgcaacatcacccactcccggtattgacatctgttccacatggtccgtcagataccgtggtatgagcagctggccggctgtggcagttatcttctgatctatctgcactgccaccggagacgtccccgtcacagttcccaagagtacgctgcacggttttgccgcctcctccgcctgtcgtgaaatgttccttaaattctcaatccaatcattatccacttattccagctcctttcaatgttaggtccatggtatgaacccccttatcaattgaatgcgtgacggcttccaccagcagatagttcctgagctgcatgtccttcacatccaggaacacgggtataagacatccggcccgtaccttgatatcaccaaatgctttcttgatggataggcttttagagggacggttgtacaggcccaaatacgtctccgctatcttctgaccgtccacccccttgtccagggactcgctcatctgcaggacaccccacttgttgatattctccgtgtgtttggtcataaacacatcacgcttctttgaatcatcattttcacggaacagcttaatctgattataggtattcttatcaatactgactgtaaagtcatagtcttgggccgtctcatcatcaatcatcacattgagcttcatgtcctccacattcctgagagtaagtttcccgacatcgtcatacagtacgaacatcttccctgtggccatcatggtcaggtccagggcattcaggataatatcaaacagtgccgtatccggctcattccggaaaggtatcgggtacccagtgtcctccagggtacctgtccgtagattgaagtcaccagcaatcatctggataacctcacccgctgtcttattctcataattgtagctgtccttattcttaaggtaccggagctggtcataggccgtgaccttgacctctccgtcactgccccagctccgctcaaagataaagccgaagaacgtgggggtcccattcacatccagccggacggcgtttccctcttcgattttaagttttccatctgatataatggagaaggagcatttccctggctgtcccttgcgttgggtttcccaggttatgctccctttcacggccggctcataaactatctgtccgttttgtatatatacatgcacattcattgtttcaactccttatggcatcactagcaccaggccagggtgaattaagttggggttgctaatcttatcccggtttaaatcatgaatctccttccaccggctcccatcccccagctgcttctttgcaatgttccacaggcagtcccctgattttacagtatacgttttggcctgcgtctgctcagccggccgattctcctccggtgtttcagccgttggagtcgcctggtcttctataatagtaaaattcataattttcgtcccataatgcctggcctccttcatggtgatggataccaccaaatccaggccctccttcacatcatccgacaccttgtagtcctccagggtcacgtccatgttggtgtcgaaggagtctcggatgacgatgaactcaaaggcgtccccactctccttaaggtcctgcaagcggctgatgaactcctccgcatcttccacactcccgtcccacatggcacatggatagtccatctggggcaggaccacgtcaacgctgatttccgcaaggcccggaggccgggttatgtttatttcctctccattaatcagagtggctgtctcattctggcctggatacttgatgggtattttctgcggagggatgggaaggagcatatcgtctatgtacacttcgtatgccatcagatatgccctccttccgctgcggatgccaggaactcactggtgaacatggacaacgcccggcccatgtcgtcaaagtcggttttcttggtcagggtgttgctgttcttgacatccaccttaagctcggccaaggtgaaacggttgattacttcctgctccgcggcatcacgcatgtattttaagtcctcgtccagcacgtccatggagtcggccatagctgctgtattgcccgctgtatttccagtgttgttatatataccttccatggtgccaggaattgttgaattatcgccaataccgtcaaatgtatttttaatgccatcgaatgcgccgcttacctttttatcaactccttctcctatcttatatcctgatttcgcagcatcatcataatcccagaaatctttggtttctacaatttctttccattccgattcgctttttgcctttgcagctgctgactcaatctttccctgtaatccttccaacccagccgttatgttcacttccactccaggtatcttattgattacatcttcgattgccttggccatattgattacacatgatatcacatttgatgctaaatcatagaaaagaatcttgacagccgcaatcggatcgttccatacattgtagaagaagtttataaaggctgctacagcattccagatatacacaaacgaattatagatattagccgccataattccaaaaacagcacctatgattcctgttgcagaaacggatgtgtcttttgttttattaatccatgccacaaccatatagaatacagcaattaaagcaataatcagaccaattatccaaactatagggcaggcaagtaaagccgcatttaatccttgttgtgctaatgtctctgtaaacgttgctactgtccatttcgaagtaaatgctgtatgcaacgctgtcgctgctgtagatattccgattactgcagcacttgccagatgggcaccattattgataagtaatgccgctgtatataagcccaatgctgcaattactccccacattataggttcaataatcgaccagttatttgatattgccctcccaataatccctacaactaatccaattccaccaaatattccttgtatctggctcgcatcgccctgcaaacctgccgtaaagtcattcatatgccgggttactacattaaccacgctccctactacaccagacagccccatgtttacagtacgccccaaggaggccaatgcgcttgtagcatcatcgtatttgacattattcaaatcctccaaattctgggttgtcagatctaccgagccattaaggtttgctaatgccatgactccttcataacctaaatcttcccacatagtgccgaaaagattgactccagcaatgttcctttgtaccggatcttccatacggctgattgcgtccatagtctgctggaatgcctgcttcgctacatctccaccttgcccaaatgctattgccatcttattggcatccaacccaatggccttgaatccttcctgtgtcgtcttgcttccgtcgatagcacgaatagaaaactccttaattgcgtcccccagtttgtcaaccgaaaacgtaccgctctgagcaccattaatcagcatattaaacatatcagtactgtcaaatccaagttttttaaactgcacggagtactcattgattgtatccagaaggtcaccgttcttatcaagcccagcctgtgcaccctgtataatcatgtcaaatgcctgcgcaccggatacgccgaactgcttttgtatcatttccgcagttctcatactttcagtcacctcataaccaaatgtatccctcaggagtattcccgcccttgtcatttgttccaacccaacacctgtctgtcccgtaatctgataaacttttgacatactctgggccacatcctccaggctttctcccatattatcagtgtacagatttgtcatactctgctttgcgacttccaatgtatctccctgcatgccggtctgggcctgcaaagtattacccgccgctcttttatcattcgcaccagtcagaatttcttttgcccccactgcaattccagccattccaagcgtaccagagattttttcccaggtttcctttaatccatgggcctccttagtcccctgcgccatgctctggttaagtttttcctccccctttctggcctgttctattgcctcatcaatctggttcatttccgtctctgcctcatttaactgccttcttgcatcatacaagcgggcagtgtcaaaaggctggctcgacacctttgccatctcctccaaggaagatatcacaatattggtagcattagctatctttttgaggaccggagacataccatcaaacagctgtatagcattctgaattgttgccacttattcaccttctttctactaccaaaaaattcacataaaagaacgtcctccgcttgaaggacgctctgattattctagcttatttgcttcttatgtgtttccaattgctcccgcaagaccatcagttccttgattgcatcatcataacttttcaacatcttctcatactgtttcacggggatggttattaatttctgcatactgcggcctccttctttccatcttccaggccagcataatatgcccgattgattttgattgctatggccttgaataattctctgtcgctctcatctgggttcttacaatctgcatatacttctacgttcactggatatgtcattatgccacctccccgtataccactatattaaataaatctgtaaaggtatcaatataatacatgggctgcacctccctctgacattgcgggctgaccgcattctctccgtactgcaatcctttttctgtcagagcattgtactttttcattcctgtagggctactagttgactttctagttctttcttccagatacccctgctcccgtaaaagtacattaaagcttcttgctttcatgcccagctcaaaacgtttgagcaaatctgtcgctgatttcatttcccgactcccgttatattcatatttgggaaggaagtccgtgggaagttcataagatgaactgcatgctctaaagaaagacacttctagttatctatgctataaaatcagcgaatttaaaaaagactcccaacgctgaataggtggattcttatgggtatagcaaaagcacctggatttctccgggtgctctgcttttacaaacctaaaagttgcttctttttgccatcatactcttcttgtgtgatggcacctgcatcaagaagatttttgtattttaaaatctcatcagctggtgatacttccgtgttattgcagccctcagtacttttttctatacctcccatatcacttagtcctaacattatcttctcagccttttcacagtaagacttaaatagtattgaatcagattttacttttccggtaggtaacaaattgatgcttaattgaggatacgaattattatagagattaacaatgattttaaattcattaatttcttccttctttttagatcccgatagtcctcccagaatagcaccgacaccaccaaataataatcctcctaccaaagcgctgcctacacctacggacaaaataccaataccatttttttgacattcatagttaataatatcatcaaatgtgaaatataaattcccgtatgattttagtttccacagcctattttgttcatcaataaaaagttctttttcaataactttagtttgatgaaatattctacttctttgttgatttatttcattatcattaatagcgtcttttactctttttagatatatatctttccatgcaagtgtgattaaacaaactccgcatttagcgatacaatccttacagacatatccatctgctatctgcttaacacctttctgtccaccacatatagaacaggcttccttgctacccccaaacagtcccatcctcaatgcctccatgccataataatctatccttattatagcctggattgccaattatttccacctctttctttgtgtcaaaaaccaacaatcaataattgtgttagttcatccatagcaaaagcacctggatttctccgggtgctcttgttacctcatatttctaaaacatcgtttttatcaatgctttgtaaaatttgtcatctacctctaacaaactgttctttccatctttaaactttatagcaactgtataaattcctttattctttgctgatagtcctgccaataatccgactggtcccaacaaagtagctcctacagctcctctaataactccactggcagcactctttctctgctcatctgttattagttcatatgcttcaatattttgtttatttaaatacattggctttccaaaagatgtagcaatatataattgccccaaactaacccctgccatcttaccaatataatcaccagcaataaccttattttgtgctcccatcctcaatacctccacgccataataatctatccttattatagcgtggattgccaattatttctacctctttcttttactcttggccttctgtgcctctttcctgtcatgctccagcttagtttcaacagatgcaatcacgacagccttttcgtatctatccaaagccaggaactcatgcggccacttatgcagcttatggaggcaatagtaagcaagattcgcttccatatcgcccccatcaattagttttttacatcttcaaccagttcttccattggcacatcgaatccgttgacttcctgcaccttctccagataattagcatactcccccgctgtcagcatagctttcaaaagcgtatccgcccccatcacatgataggagtcctggagttctttatcattgagattcggaaataccgtacatttagatgccagtttccccagatactgattatagtctgtttcctgggtatactgtccctttttaccaactaccggcacccttttagtacactctcgtcttaacgcctcatcttcggttgatgtgatggactgtatttcccattccattggccttcctgccttatccagaaagcgccttgataccacacgctttacgttttccgccttgactgcgttctgcgctaaaaaacagcttaaatctcccatattctcttatcctctctttcttactgcattccctgcaagtgactaaactgctctggcatctcccaatcctcgaaggtaaaatcaaggtcttcgtccagatactctgcatccgcatcgaacttcgccaagattcctccgtccacgttacaatccttcaggatgatggtctgccgtcccacactggaagtcgggtcttcattggttatctggatatcaaaatacacgtcctgtccagtctccttgtatcggtacaactgctccctaaagatgctggtattgtagtggaaggtcgcggacccgctccccttccagccggttgtcttatttccttttccggtcctccccagaatagggatttcagactttgttttctctatgctggcctccaggttaatggcctgcataaaattatagcggttcccttcaatcgtgacaaaacactccgccagggatgcgctcacggcatcctttgcattcattgactgcatatatgtatctccttccttatgaaacaactactgtcatatataactgcgacatacagttaatcggtgtcaccgggcaattcaccacaacagaccgcttgctgttcccgcgctctaccgtgatttcttttgcctccacggcctcaatcgcccgcagccttgccagttctttattgtaggtcacaatgtcgttccagaggctcacccggcccgcgtcatcgttcggcatgattcccaggtactttgtgttgaacatagatgcgatatcattaccaatctggtccaggacgcgcacagtctgattattcgagaaatcttccttcttctcttccgtaaaggtcaccaacgtgttaatatccatcaggactcgcacatcatcacctacgcgatggaacatgaattttcctgaacggacagccctcgcaagctgttcctgcgtgtaatccacatccaccgtgagttcaccatcgtatacgcggttctcgttggtcttgttaaccgcacaggccgcctgaaccccgcaggtccagtacacaagcccctgctccagctctgccgccttgttctccacggatatgattccctcatagtccgcatcagccatccgatacatcactgtttggaacttcacgccggcctcgtcacgcatccgcctggtatactccgtaaatacagccttgactgcatcatccatggatgggcagcacaatgtctggaatgtataggactccatcttggccaagaactgtgcatagtcctctccgttcaccgcttccccgttcgtcccaccagtaaatgggattccagccgttgctgccagagttgcatccttcttgaacacaacgtacagattatccttgagctctgatgctgctgccacggtctggcggtccacctcctttttatcgagcatggttttcacatcaaacttcgtgctgtcatccacattggcactgatgaccagcatcaggtccctgccgcgtacaccactgtatttcgcctgtccataatcacaagcagccttaactcctccattgagccggtaaaagatacccttcgtcaggttcctgaataactccctgacctgccacatctgcggcgcatctgccggatacccgaatatctcctggcaccgctcctggtaatcctgggctgtcacaatgaaagcctccttttccggcccccaaccaaactccagagggattgccgccgtcccacggtctgatagtaccgcaacgctgctggcagcactcacaaaattgatataagctccgggaagtattttattctgaaccgtaaagcttccgcctcctaacatttatttcacctttcctttcatgaatttatctattaccgcatctacttctttcaatgaatacttcctgccatcttccagcagggcactcaccaggtccttctttccctggtagcactccgcctccagcagtccctgttttaaaaatgttgcttctccctgttttgtttctttcaattcccaaacctccttaactgtgtgttggcctccagcccctccattgacgcctcctgtggctccggtttcatgacgaacatattgtaactgacaaagaaggtgagcacgccatcctctgtcctgtgactgcggccggtcccccgcagcaggctgccatcctctaatgtgatatactccagcccgtccatgaggatgtccgccgtccggttcatttcacgagagggctggggggtatcgccaggaaggtactggatacacatagccgtctcacgatagtatctctgaccaatcaccggcttttcagacggttccagaaactgcacaaaaaaacaaggctccttaaggccctgttctaccgcatctgtgtaaatttcataaccatcgccaaacagttcattcagccgcctggtgacagcatccatgatattattaagcatcgaacacctcccgaagttttgcttccagctttttctctatcagcttcggcgccaggtcattgatttctttttccgatatggtaagcatgaactttcccgggacccaagccttttttgcacttacgcctaaggctgggatatagcgcccaggtgtctgccgatgaccatattccacgtaggacgcatattcggtcgggttgataatttcaatctggtagttatcccctatcctctggatgtcacccaccgtccagccgcgtcttaacgtcccgccctgatatccggcccagtatttttgctttataactccattctttgacagaaaggtccttgtcttaccatcggaaccctttacctttactgtcttcgttccatccagcttaggagccttgcctaccggtgttctctgtgtaactttcctcagcaggcgggaggctaattcctggatgcattcccggttgaaggcatccctctcctgctccagacgttctatctgcttttgcagcttctttatttcccgaaaatcaaaacttcctcccttcgccattatgcatactccttccatatctccagaagaatctcctgatgggaggagtataccgcggcctttccactctgggcataactctccgtccggccctgctgggtgacctcaatccggcatcccgggggaaccacaagctccggagccagaaacaacttgatggtctgtgccacacccgtaaccgtatcactgccggccgccggcgccgtgctggagtaagacagatggcaggctacaccatcctgtacaatggcctcctcctgcctcgtcaccttcgtcacagggtcctttacagactgcataccataaatcctgcatgttccatcgtaagtggcctctatggccttcctgtgcatcctctgtgcccgtttgattgcctcacttaccattctaccaccccagcttcctgtaccggttaagttgcccctggtaatccttcaggataccgcctgataaggcatccgccgcacttgtaaagctggtggatgtgtccccttccgatatggatgatacccggtccggcgcctccccatccccgggacgctcataccggtacaggtctattgccatccggtatgatgtgctggtcaagcctgccggaactgcttttaagttgcagtagttccggatagtctcatccacatcctccataaggaactgcagagcgatattctgtgttgtatcgccttcaggtatccccaataacgccttcagcttcattaggtccatggcccctccttacgaaatggtagcaataaatacctggtctgcatacggaaatgaaggcatggccgtggcaacagccttaatccaccggccgacagggtctaccgtgtcatattgtaccaccacgatattccccacagcagacacatccacatccggattcttacggagctccagctcctcggccgtaagaccatagaatgtatcccccagtttcccatccggcatcataatgaatgcagattccggaaggaagcgcgcggacgaatatttcccctttgcatcctgctggcggtactgtttgtcataaatggcaatctgcggcaggctctgctgggccaggaaagcattcagctccgccctggtaagcacccggtcactgttcacaccgtagattgcagcgcgtatcctgtggtcccgtaaaatgcggttcagattggtcttggatgtcaatgcccgtgttggtgtgaacccggtgtcttttacaatccggtccacaaaggcatccatatcctccaggatagtggggtcaccgctcccccatgtcttatcagccttatgcgtgctcggaattccataatcaatgcttgccttgaagccgttctcattgatggaaagctttcctgtggacagggcttccattctcaagcactcgactctggttttcactcccgccaccaggttatccacgtcgctgtaaattttccggaccatctccgcctcttcctggacattcctgggactttcaagggcaataatttccttctcacccaggcggattttcctcttgatgagggccaggtcctgcatgctgtaatcagcgccttctctggagcccagttctgtctccgtatcaaacgcatgaatatgggcagatacgggaaggtcggacgcacccttaatcatcttaatttccattgcttcagtcttacgttccggaaaaagcaactcacccatataggcttcggtctgcctttctttcgtataatcaatcagctcctgtggtgttaataattcttctactcttggcatgtcttaatcctccttatactgtgggtgtggcagccttgacctgcaggctcccatccacaaaaaatttaataaatggcatcttttccaccatctggtccacagcatcaaccaggtattccccctgcagccgctccgtgttgacggaaccggcaatcatcagggccccggcctgctgtccgtatgtgacctcagtggttgcgaaaagaatgccaacgggttccgtggaaaatgtgtacgtataagccccggagctcccgctgcgcgcaacctttaccatctttccatccttgtccagcagactgcctgccagaacaaatttcttcccctcggtgtccgctgtcaccccggtgtccagtaccgtacaggtgatgttctcataatgctcattccgcaggaactccggagaattatcgtacgtcttctttactaaatacatgtcatttcctctctttctctattttgttgcccatgcatccgcataggggttttttgaggtttctttgttcaggctctccgccactgtcttggcccatccaccctctgatgtctcgccggccttgggtttataaccgttttttccgcttccctgcctgacggccgcaggagtagaatccttgaacaggaacgccttaccttccttcagtgccttcacctgttcttcaaggccagtgactttcccgtcgtcccctaggagcagcttgcttttatcaacaagtccggacacaaggtcagcgtcatgggcggagtcaccgattgcaagtttgatggcggtggtcagcttcagttccttcatatccgcctcatatttctctttggcagccttattctctgcctgcaggtccgtaatctgtttctggagctcctcgctgctgccactggccttcttcagttcctccaattgtttgtccctggtcttgatgtctttctccagttggacctttgtggcgttgagggcctccaggtccgttttagggacgtagccctccaactccttctttgattcccgctccgctttggatgccagctcctcgctgatgcccagagcgacaaaatcttcttttttcatagtctcttcctttcttttggacgtaaaaataacacccgggatagtcccgcgtgctcatttaaacttagttatttcaattatcgcgacaaaataaaataccaccggccctttgctgactggtggtactaataccacatgactaatttctcatctggcatattcttttcccttgataattttaacaactcgatttgtgcgtggttaacatgatttctacaccactcatatccctctggcaggctgtattcacgaagattaccggaagctatgtcaactaccacatgccctttttgcttactatcttccggaataatgtcacattctatgacacggttattcctttttatattttttaattttagcatagaatttactcgcctccttgctgtaattatattccgctgatgtcagtctatgtgcttcatcctgactgtatccttggcctattaattccttttccttaatctcatgctttaggagcgtcagatcgtgcgactccggttttccatcaatcagtcttctccacgattcggccatcatataatcgggcgcgaaatattctggttctgggccgcccaggtcatgcttatccaagaaaataaagttcttaatctcctgaatctgctcctctgaataacctgttgattttgcgattttaggaacatcggttttcatactccgtacaagcccgtagtatctttctgcatgatctttcgcagcatttccattcggattcctcgccccgcttactgctcctgacttcattatatcaggttctatctgcatttcaacaacaaaccgcttttcccactcccggtacttcatgtccgccggaacataatatgtctttccgtccccatccctagcagcccgctgttccccttctgtaaactcatcgtcaaagtacggcaccgtggtggacctgcaattggggtgaaaaggcggtgctgtaatgcccaccttgtaatccttcatgtcaaagaccttaccgtccatatccctgcatatttcagaggtttggccgtccagcgtggccagaatctcatacttctccactcccagttccttcaagcagtccttttgagccgccgatgagatggccgcggattcagtcatgatgaggcgcccggcctgactccgactgacctccatggtctttgacaggctgtctatggctttctgaggagactcaccacggatgatgttctgcgtcagctcggtatgcaggttcctgactaatttatccttatttgtccagatacggctcgagaagtcctccccatcctgcgcccatggccttttgatgacagcttctatcttcctgtcatccagccgggccagattggttcccgccccggtccctttcgccacctcgaaagcggttcggtaatactgctccccataggccttatgcaggtaatccgtcatgcccccctcgaactccgttgataacagctctgcgtgctgctgcatctgaagcttcattgcctccaggtaggatatatggtggcgagcggatgcattctccagttccttcatccagcgctggtcaactgcattttcctctccggcttttatgtaatccttgaccgtccacttgaactcctccaactcattcttcttaagcagcttcttggcacccgcataactgatgtcattgttgtctgccaggcgctggtaccaccggccaatgtccatctggatactgttggtggctcttatgtactggcgctggacatccttgtaataggctgcgctgcgctggtactggtcatcctccagggaagccatgcgttttacccaatagtctgtatttttagccgtggggcacacctcctctcattgcttttcgttttcttctggtctataatatctttatcagggctacccaaacactaaagaacgaggactttacgccaattctgacgaaaagtacggagtaagaaaaggaggtttctatgcgcctaaattcggactgtatccgcaatattttaattacagttgaatcaatagaatatgataccgcttattcaatgtccgaactttgtaacaaacttcctaactattcagaggacgatttgaactaccattgcctccagctcatcgatgcaggatttcttaatgccacagcaataaatataatgggacacacaacaccgcgggtatggaaaatcttcgacttaacctatctaggccaccagtttttagctgatatacgttctgatactacatggaataaaaccaaggttattgccaaatccgttggttctgagtctttacatgcattaaaagagatcgctgttggtgtagtcacctctgcaatacagagccaacttggtctacattaaccaacatcgtcaccgtcaacttcgctggctcatttgacccggcggagttttctaatttgtaatctgtcacattattaacttctatcccatccaggaaaatctgctccttctcattaatacagactgatttaagtctcatccccttcaccgccttcctcttcctcctgttttccctgctgcttgaatgcctgctggtataaatctaccttctgcgcattttcatcttcttccctcttcagctgcttttcttcctcctctgcattttccacccatggatgattcttaagaatggtcttatgggagatgacgcccgtgctttttgtagcgatgtcagccagttccgattcactccggatggccgtcctggtccatgtctgcgttatctgcttacactcggcccccagatgatgacatatggcccgtaccaaccggccaaaccccagcttgaactccgtctccatcaggcccgccttcagctccaaaagggagtacaggtatttcagtgcttccccagaggtatttccaaacttctgcggatccggatccacacccattccctgttcaaagattgctttcctggtaatctccagaaatttctctctggcctctatcggaatactgatagtcaaggcctccacacctccgctccctccagcgccgtcagtctccaccttaattgccttgtattctttcagttccgcaatgaaagacttgaggtcctggcccccatagttagtcagtataaatatgatttcctgcgtatcctcgaggtcatttaaaaagccgctgaataccttgtcataggcatctgacagcagctttatattggttaaatcatctgtgggaatattattgttataaaatgggatgaatggcacctctccaaaaccatgctcaaacacattcgtctgctccacactctcatccggggagccggtcagctcatacacgttatacggctccaaccctgtttcagaaatggaactgcttttctttttatacacatagcatttttctgccgtccaatactcccacacatagatggccttaccgtcaataacatccctggttttatagttccgcagcacggcatccagctggcggtccaagtccgcggaatagactggggtaatctgctttgggtcaataaccccatacttccattgcccatcatcatccttccagtagtgcagccacgccaccttgcagtttgaggcctttatgcataagtccttgcataccttggcgtatttatcccccagcaggtctgctatctgcctattcaccttttcatttcccacatcaaacagcggcggcgctgaaaacatataagcagccttctggttgaccagcaggccgtgaaagttccgcggtatccggttatccgcatttctcagcgggtcattgtcccggttcttccctataccaaaaagaatatcattcttattctcataataccgttctgccgccttggactcccggacaaaacgtcggtgccctgcggaatagctctttattagttcctttacaatatcaatcgtcatggcctgtggcatcccaccacctcctttactttaagaccgatatgctgcctcctttgaggtctgatacctcgtaatcatctagtccataccagatagcggatagtgtatgggggtcaatattgaattcatcctcaatgatttccccatccttatccacggcaaatgtcaattccttcagctcattgatgatgttctggcaccgctctgagcatacaatactcctgaaccgcttgacctttttggtgtacacctcccgggacccctggaacttcttgcagggcttcatccggaatccctgttgtttgtaatatcggattgcctttggttctgcgcagtcagcctttataagtatgcccttccatttctctatgtctcgcgcaatctccgggtctgtcttatctctggaataatattcgtcatacagataaagaattttattatcgtggtctatcatcattcgtaccacagcattgtaggaagtcacgaaaccaaagtccattccgttcttttcaatcggattggtaatccccttcatgcattcagcaatttctctttcggtacgtacttcaaactgcgggaacaccagccttccgttaataccaaagcgccctttcctggccacccggtacaagtctggatcatgctgctgcaactcgtccagctgctcgatgtaatccgccggtacaaagtagttgtcatccacagtgctgtggtgatagtacgtgttgccgaccaccattatgcggttctgatacagttcctcatcatccaacaccttgtagccggctgccttgtcctgaaaaaaacacttgtaaacccagttgcttttgctgacagggtttgtggacagaataatgtgattgctgagggtcggatgacggagacgtcccagaatctccttgaatcccgcatacttgacttcggaacactcctctatccagacgatactgacaccattcagggatttcagctttgccggcttgtccatgcctttgaagatgatgcggctgccgttactgaagcgcacctgcatcggagacgtggtaaacgtgatatagtccgtcacctccatggcttcggccacttccatcagaaggtcatagcaggaatcccgaatggtatcgaatacctcgcggaccaccagggccttgcgtttctcctccagcagcttcttaatcagcttcacggcaatatggtagctcttagaactgccataaccgccaacagtcagatatatcttatggtcccagtcatggacgaaatcaaagaaatggtcattcagagaaaattctacctgcctggtctcagcaatcttaacttccatacttttcacccgctttcttgaatgttatctggatcggcttttcttcgtccttctcaacctgggacttcagaactgcaatccgcgccttctgctcctcactggccagctcccagtttttatgcaggagctcatcatactgtttgataagcccctccagcgttttctgggctctggcctgcgcctgcaggaaattgccctgcttatcccaagcctgctgtacctcccagcgctcctctgtgaccgtctccccatccttatggcctatcttagtgatggtcacatccttctggtccctcacatacatgatggactgcgcccggatgattgcagcataagctatctgcacttggtcccataggatgtccagcgggtccgtaggcatctcctggataatggaaacggtctcctcaggcaagtacttgctaaagaaaccgtatttttctgcgttcttattctgttttggagccccatggccaacagcattttgattacccgcaggagctcctttatgattagtaacgttacctttcgcatttggtaacgttactttatcccacttgtcttgatttttccatttacgaatctgttcttctgatacctgcaactcagcagcaatgtctttcaactggcgtttccgcccactgtccagccatagctgcagcgctttgtccctgttagggctcctgggtcttggcataatcaccacctcttgtcatggcataataaaagcacctgcaaatatccgcagatgcaaaaacttataaatgtacatattttgcttgacatatacgtacgtatatgctataattaaatcatagaaaggaggtgaacacatgaaagacttaccaaagaaaatcaaaaagctcaacaagttgtgcgaccaactcattgagctactggtaaaagcatacatcatcctactggtgattgaagcacttaccaaaatcgtttagggattggggcgcgagcccctttccttccaacaatattataccacaagtctttcatgataacaatgctcaaaaagaagccaatattaggcagtatccttttagcatcaaaactgctggtaattataatacttttgtatttaatcatcagcagtaccatccaatttatcaaatattaggaggccccacatgtctgaagataagaaatatacatctcagcaaaagcatctacgcactaagtatgtccgttttcctcttgacttgaaaccagaggtcctggatgcattcaaggccaaatgcgacataatgggaactactcccacaactgaaataaaaaaattcataaacaactttatttcggaggatgaggcggccgattaggcggcctttcctttgtttgttttggggtatgggaaaggaccacctccgggcggccctataacaactattacaattcaaaatccatatctgatttttcttcaatttcactctcaatttttgcttttaaagcaatacatttttcgtaatccaaatatggtgccctaacatcgactctcataattagtttagttacatattcaaaatactcctgctctctatttatttttaagcgagcatcatcggatatactatagttcccatactcgatatccatctgttgagcaactctgtccactcgcttaatgcttttaaatatatctacatttttatttaaaagcatttcattaataatataattattggttctgttatgcaatactaaatcactggttcttaacaatgtaattgtactcatccgtcctttattgacgctagcaaatatttcttgtggacgacttctaaatgccttttctgcttcttctgatgatgcaaaatgaaccaataccatttcatgcgtaaacatactgctttttctaaaatctactaacgccctgtcatactttgaataaatatctgcatcataataagcctcgtattgttttatgaatttacatatatgcggatataaaataattcttcttgctatatcgggcttcatatcataacaaaaatctattacatttttataacgatcaagcttttcagagttaaccattttttcaaattgaatctcggtttttccgctgtcataacaaatatagcccgcagcaaaatattccataaacgatttatgtgcccacctgtaatcattaccatctttctgaaacaaaggaaccgcatgtgttaaatcgtccaaaacatcaagtgttgacaccttcacccaagacatattttttaaacatttatcaataacatctacaatcgcttgttttgtatactctacctggttattcttcaaagacataaatgcaattcttcgcaaaagtttttcaaagtctaaactatctaactgtgattttttcggatgaacatacgctcctccttttgtcttgtcgtgatcattatacaacgcttcataaacctggctataaaaaccgagttttttgtatgagatttcctctttatattcaaatgttttgtacaataatgatgttaacatcggattaatgagaaattctttcaaaatatcaagttgattatccttcgttatacgctcaattaatcgctcagacttctctccattattatcatattttctaatcaacgaaaatgcctcttccactgacaatggttttattgaaaaacgttgaaaatctccaaaacaattcagatcgttttcatctctcgatgtcaaaacatatttatttttacccgcctttttaataaaattttgtatattatctaatacaccccctctattttcattagtaatctcatcgtaaccatcaaaaaaaataatgaaatcacctcttttcaacattttaacaaaatctttcttttcgatttttttatccaataattcaaattgctctaatatatagtctaataattctatggatttatcagcctttcgcaattcaattattataggaatgtaatcattatgattaattgactgtatcgacaaatatttgaccaaagtggattttcccataccagcagtatcaataatcaatattttattataactattaatacattctgcataatcatcgtcaattatgtattcttcatcttcttctgcatcaattccattatgggtagttaatgtcaatggtatatataaatcatatatggttttaggtatacccctaaaaactattgtattcatagacattgccttgttataactcgtctccaaatattcttccaaacattcttctaaatatacagagttatctttataatcagcatgtttctgtaacataggcttaatatgcgtctctacagccgtttctactatcttttttatcatttcaggggctcctatctgagcaattaagatccctgcttctgctaaattcatccccatatatcacactctccattcgacattttcttacagtatatcacacgacaaatgaaaaatcctaccaaatacacttctatcttttgtcgattatgtatcaaaaaaaggacaccctatttctaggatgccctaatcgtatccggaaaacgtcatgggggataaaaccagatacctcaccgcttgtgtaccctgcggcattgtcccgttaaagtacaggtctgtcttataagggattacacaataccggttagtcagccaccagggtatgatgcctggcagccgtaaatcaaggagctttataattacgagttatccatttatcatattcttccaaatagacaaatgcactccctaccagcaaatggttcgtttctagcagctattacaaacccttccttcatagtctgtatataagcactgccgtgtgcacagttgaaataccctactccatcctgcgctcttatcataagtgaaattggcaaaaaattttcactattacataaatcaggataaggaataggcgcatcatttaaagctcctacgactccattgattttatacaacgcctcaaacggaaacgtatcctctccgttgcctccacaacatccacagttaatcgtaatacagcttgctttctcattcataattaatacctctctttctttgaaaacaaaagcagccatccagttacataccagacagctgctcattgtaggggagtgaaaaatcaagtctttttcatatcacctaattttgcatattacaattataaatcgtccaaacggacatggcaaggacacgattttgacatgctcctgtcaaggccctaatccagcataagggcgtctgaaccaaagaggtatacactaagtatccctgtaaactccgttatccaccgtctggccgtccgctctccatatccgtaaatctctgcaatattctcgtatgtcatcccatccaggtagaaatatttaaaggccagatatttctcatgcgtattcttccgacactcctcatcctacaggagcttcaggcacttatctatgcggcctatcatgacaatgctccggagcttgctcttaagaatgctgttgataaaaatatcttcctccgtgaactcctccagttcttccctgttgtccatatcagaaagctccgccattcccgcagtcctcacaggctaccatctgtaaacaaaatctatcctgcatatagatctcccttcttactcgtacttgatgcaataaagtacggccacgtttgttggtctggatgtataaccataggcaccaacatttgaagaagacctaagaggacttaatactatatcctgataagtcctacttccactagcttttaatacagtatctgtattttccatagggttgttagacttgtctgaattgtattcacatgctaatttctgattgttcttaccatcagaaaaaagaaaaattcccggtaatttagttgactcttggtgttttccgacatccatagataacttttcttccgtctccccatggtatcctctcaaaaactcgttccgcaggtccggcaccgcaaacgttgtagctccgtcgcctccaaagtaatcaaccgcaccaaatccatcaaggatctggttagacagcagcgggtaatcctcgatattatattccgcaccgtcacacgccagataatgatccgggactttcgtgctcatgtatgcgatcacggtacccaccggtgtgccgtctgctccgcctcctgatcctgctggtccacgatctcctttcggtccctgcgccgcaatcccagtatcctcattaccaatccaccagtttccgttttcaccgatcaccggtacagcgatcacaccactggccgttccatgtaaatttactacttcaaaacctttttgcattaaaatacctctctttcttcaataaaaaacagctatccggctatatacctgacagctgcttattatgggggtaggaagtggttctctcaaccatttccatgctaccataatatcacggaagtccccctttgagtgctccaatttatcttttctgcgccaacaaatagaaaaagtatttcctcaccccataaaaatccgatctacacatcggcacatctagataatcatacccaatgccttccgtcacatttttaagcaaccactgataaatatccgcgcctgcctctataaccgtctgctcaaccagctcaatgtctgcctgtaacatagcattatgtattgccgcccgtgctacaggattccctggaagattccctttgggcattccatcactgataacagcacctaatccgtaccctctatgcagctcctgctttttctcatcatattgcatacagaagtatttcagctcattatacttcgcgcgggagatattgtaatcactcagcttcatgtcccgctttctcaccttgtccatcggcatcacctccaaactttcgattaaaccacatcctcagtctcaacaacatcatccgcattggcggctcccgcagctccggaaccgggcacaggctggtgtacatgtaggccggcgccgtccggatgcgctccttgatggcctcgtcggcctgggcggccagggccttgctgcggtcgatgcggctgaccttggactgcttactgtctttctttctcatagacaccactgcctcattacgtctgttaccacctttaggagctgtactgcaagattcagtcctatataaaatcctgctcctacgatgatgccaaagctgtaccattcaagtacctttttaatacactccttgcacatctcctgattctcctttcgtatcaaagtttcagtttggttcatcatgatatttcaatgcctggccgcaagttggacagaaataatcatcatcctcaaccacatctgaatcacataccggacagaggcactctgcttcatcaccagctgaataatatgattgatatgctggtgtccacaccaccattctcggctcgcttttgtcttttaaatactggacttctcctggcgtcaggccggtatcctcataggctttcagcttttctttctgttgcagcatgattgccttcacccgttgcagtaccgacaacgtaaaagtattatcccgttccgcgttggactttattgcagcatccagctctatgatgtctttttcaaaatctctttccatccaggctcctttctccggttctcccagaaatcctaattctggttacagccttttttcaccttctgaatttctttcagtttctcaatcagcaacgaccggttcatatcgcaatcccggaagaacttcccatcccgcagcagatagtactcatgccggccgtaaccatcatgatatttggcctcatagcttcctgacgcatatccatcgaatatccttgcgtgatacaccttgaccaccatgctggtgccgtcctccaggtcataccgatagtaccgttccccggtctgtttcgtctcaatccataacggccacgtctcatatgcatccacgaaggcagcccgttggtcattgttcttaagcaccggcagttccggctgctctggcttcggcggcggattcacgatgtcatccaaatcgcacacatagctgaccagggcgcaaacctttattttcagccggcggatatgtatgtcattttcatccacatcacattttagcccatcattaagcagctttttggcacgccccagttcatcctgggcaatctgcagctcggtcatgggttcctccggggcccggatgtcctcctccgtttctgaaatctctgtgaattcaccatcaatcacggtatcctgggattccggcataccaggaacatcgtcttcatgttctgatgcctcatcctcagcacttcccaagaggctgagtaattcctttacgtacttgccccaggtcaagctcagaaatgtctcgcacatattatcctggaaatgaatccgttccgggccgcattgataaaagccgtactccgttgacccgctgttatggggttctccgtgattgcttatcagctcctgcctcagaagtttcacgttcccgtcattggcggcctgcgcacacagcttggacatgtgatgctgatagaagtccagaacacattcctcctgggaagggatggctgttttcccctgttgcacatccgcggcttccagtagcggacaatccggctctgcctttggggtttccagatgctccgggcgccgctgcgaactataacattccaactcacagtcaccgcgcctgacgcattcccagcagcacacccggctgcagtcctccccggttcccgggatgagcttatgggcctcctccagggtacagtcaaattctggccggtggatgcacttcccggacttttccggacggggcggttccggctctggctccgtctgggcttcctggtggggctctggttcttgctccggggttgcgacggtcgcaactttcttctcttttcttggcttcagtgcccggatggctttgaccgacatatctggggtgacctgttcctgcaactcctcctgcataggtatcatctctatcagctggctgacattgtacgactcatatgcatcttccagcctcggcagttctcctggctctaccgggatgccgaatttgtcatacagattgatacacctggacgcccaagacttgtccttgccgtattcatcacccaaaaactcgttaaagctgtcatagccttgtccctgccacagcttttcatcccggatgattttcaggtaataaccgaagcctacaaaaccatttttgatatccttgtaggatatattcgccagccgcctggtatctataaaggtcaatcctgttttcttaacttcctccatcatttcctcctagaatcttatcagcatccttcagtatgccttcataccgttcggccagcttccggtgttcgtccatctctcttttataccgaacggtctttgccttgtagcggcttacatccttctttgcattggtcagcttttccttgtccctggtgtacacggcataacaggggctctgcatccgctcatacatctcctgcagttctgccagctccgtacggcagtccacatacttcttcgcaaaggctttagcccggtccgtctcatcctgccgtctgtccgtaagccattccctgatttctctggcgttcttctcatccggccaggaagctcttacccacttaagcattttatgtatctgtggccttctggcctcctggaagaaagtctctaagtttatctccatcctcccgtttgggatgttgaatctaattaccatcctttatcctccttatcctcgccttaagggactccattacccaattctgtacatcatctttgcgctgcagagcctgcattacatcctcatcccgtgtcccgctgcacaccagatggtggatgatgaccttctcctgctgtccctggcggtgcaggcgcttattggcctgggtgtataactcatagttccatgtaaggccgaaccagatgacgtgattcccaccctgctgcaggttcagtccgtaggcgctgctggccggatgggtcagaagcacatctatctctctggcattccagtcatcctcatcctgtggcgtcttaagctccctcaccctcaatccggttttctccagggccttaaggattctcgaccggtcgtgctggtagttgtagaacacaagtgccggcttcccctgaagggattccatcagctccataaacgcctccaatttgcagtcatggacctcatggacctgcctgtcctcgtcgtaaatagccccgttggccagctgcagcagcttattactcagggccgccgcactggttacactaatgtcctctccatcctctggcagctgcagaaccatctcacgctccagctcacagtatgctttgagagcctttgcgtccagctccaccggtatctcatggtacgtgatatccggaagctgcaggtaatcctccgccttcatgctgatgcagatatcggatatcttctccagaataccttcctcactcccgggcttagcctcgtaactgtacaccatgccgtctgctccgcgcttatccggctgaaaataccgttccctgaaatgggtgtaccgtttccccagacgctcgccgccgtccagcaggaatacctgggcccacaggtcgttcagaccattgggggatggggttcccgtcagctctaccattctgtcgatgcgctctcctacactggccaacgccttgaagcgtttagcgctgtggctcttaaaactgctgctctcatccaccaccaccatgtcaaaaggccaggcgttccggtaataatccaccagccacaccacattttcgcggttggtaatgtagatgtcggccggcgtgttcagtgccttcacccgcttggactggctccccagtaccggggacacccgcagcatttttgtgtggtcccacttggcggcctctcttgtccaggttccctccgccaccttttttggggcaatcaccaggacgcgccgtacttggaaccggttatacttaagttccttgatggccgtcagcgtggtgaccgtcttgccaaggcccttaacccatatcaagccagagacccagcttttttatttcgataatccggttgatacagtgtaactggtagtcatgtggtttgaatatcatagggcatcacctcctttatgttccttgtgccatctggcgtgttcagcctgactctgaaacaccatcaggttatccggcctgttatttcgtttatttccatcaatgtggtggactatttcaccgggtaatagttctctgcccaatgttctagcggctacaatacggtgcgtatgaattccaaaagacttggtataggtctttccttttccagttcctctgtgcgccatactcaatttaacccttgtaggaaatgtcattctggccgggttaagtttttggttaagttccgtcatgtgcctggacattcctgtatagtctttcaaattctggtatccattcggattctttgctttacttgaatagttcgcaaggcattttcggcaacaaaaatttcttggtttaactttgcatggatatgtctgtatcttcttcccgcaccatgcacatacagtttctaccatccccatcctccttcacgtcctttgtggtcaatccccatctgcctccgcctccttttcaaaccgtcttaacttcaatccggttccgcagtcctccaggaactgctccacctcctggattcctctcagcacccttacgtcctgccccatgtcctgaaggcgcctgagctgcgcggtttgcaatacgctcagcttcccatactcagcctttagctccacgaataccggcggcctgtccgggaataccactatccggtctggcaccccaccgttaccagggcttacccatttataggcccggccgcccagtttccttacctccgccaccaggaccttctcaatatccttctcaagcatcttcaattcctcctgtataccgactgtccttatacgcgtatgtgatatacgtaacaggtacgttaggtgatatatgcgcgtatcttatttatctatttttattcttatatagataattggtttacatagtttacatatattagttttccttgtgcttacaaggttttcccgtgaactatacatgtaaacttgctgtaaacctgtaaactttctccctgtaaaccacgtaaaccttgcatactttcttttttttctttaaagtttacatgcgttcaaatcccttttgcgtaccatagggaccaaaccggcggacgcttttgttccttctccatccttttatacctgtaaggatattgttgatttccgtgctgtccgagcgcttcatgtacttggcatcactgttgaaacattccacccatatctccaccgcgcatactttttcacgcggcacaagtgtggccccatccggcagctgcttattcccgttccagaacatcctgcggtcaaatagagccatcgaatcccagtttgaaggtattggcttctccaggaagtcctgtatgattccctctttccctgacagctccctgtggctctcctgctgctccatggccgcggcctctatctctttaggcagatacagctgttcccccatagcccagtacatgtaggcttccgcccatatctggtccacctcacccggcatatccgtccagatggatttctgcgccggatgcaggcctacatctaccggccagaaccggcggttgcccgttgcatccttcagaaactcattgtcgttgctggtcccgaagaacacacagcgcctcgggtgcttctctgtctgtctgccataggccgctctgtagatatcaaaacatttacttaaaaactgtttgatggcggatgtctcctgttttgtaaaagccgtaagctctcccacctcattaatccacgttccctgaatcaactccgcggcgtccttgccctcaaatgatgtcaggctgtctgaaaaccatgccttccccagattgtccagaaatgtactctttccgattccctgtggtcctgtaatgatgggcatgttatcatatttcacaccgcccaccacggcccttgccacggccgcgcacagagacttacgcatgactgcccttgtataaggcgtgtcatcggctcccaggtagacacttaacagggtatccacccgttttaccccatcccatgtgagactctgaaggtactgcttgacctcgttaatcttgttctgctctcccacaatcgccagggcatccgtcatgttgttccgggccgtaatgccatagtatgtttccatgtaccagtagaaacccgaaatgtccgtatcagtccataaccgtttctctgtctccttgttccatggcaccgcgcccaagaccagacccctgcccgcaaattcatctgtgacaattctgcctttcagaagcggatcattttgcagtaccaggataatgttattcaccgtcttcttataattcccgttcccgtccactgccagttgtcccagccagtccaagttttcaggatccgtcaccgtggttccttcagcggaagcgaacgccgtcacagccgcgtcatgtttctcccgcgctatccggtcagccaccgccttgtcagctagtgcaagcttactcatggccacgaaggatggcagcttgttgactggtgttccgtctttggctgcggcatccttatcaccgtacatgtgcagccggaccaggtcgaacgcgttgaccagctggccgcagcaggggtcgtgggagtgatgggaatacaggaacaggccgccatcatatacgatggcgccgccggttgtctcgcctccggtgtaggtgtagcgccccgttgtggccgtctcatcatacatccccggtatgaaccgctccatcgcctccacgatgccgtacgtccggcagaatgcgcctatgataccccgttttgtcgtggggtcctcctgcttggccagcctgcgccgctccattgcctccgctcctggcacctggggccactgggtgacgtccttccagtccccgtacatccccagcagcccgtccaggttgcagaacggcttgtcatatacctggtatacatactggctgtcgctgcagcagcttggccagtacatgagcctgtgaggttcaaacgtggtcgggtcacaaaattcaatccccaaaagagacgccagtttcctggccgccggctcatactcgtctgccgttgccgtccggtccaccggtacgatgacacgcagccgcggcgcatacccgctgtgtttccgggtgctgtacacggccgcggcgcaccccagtccgcccacacgcctcaggatgtcatccgtctgccccgcgggtatattgtccaggtccagtgtgagcaggtccctgccctccacgtggtcctgcttcctgcggttccccttcagggtgccgcctacgaatccgcctatgtccttaagttcatcctgctgcgcctttgggaaagcaaggtactgctccagcgtctcgtctccccttaccggggtgctgagcttctctgtgaattcggaccacatcatggtgcttcccggccactgtatcgccttccggcttcctgctgtgctgatatgcagcattctgttattctgcaccctgttccctcctagtccttcatgtagtagtcgctctcaaacccggctcccttaagtaccagccccggggcccagggtatcggttcggccatcaggccgcatatttcgtccaccgttgtttccataggcgcgtcaatgataacctcgtcatgcacatggaacaccacttgcaggcctctggccgcaattcgttccagtgtcacggccaggcagtctctggcgatagcctggacgatgttctcggtcatcttgcctccataggtcgatgtgaccccccacttccgcgtctgctggcccaccgtgtggtaatggatggcagttttttcgaattggttttcctttagaaatggccggcaatagtacagcttccgtccacttggtaatcgcacagtaaggaaagactggccgtaaatgaggtccccctccaatgcgaatataagtccgttgataccctgcggctgcgccgtctccatgacggtgagggccgcgttctccacggcataccacaggccacatatctgccggttcgcctggcgccaccgctgcacaatgtccggcagttcctcctcggtaaggccctgtttcagggcccccatggcaatcagagaattggcgcctccctggtaccccagggccagcgtggccacctttcctttctgtctcagagcatattccgggtatcctttcacaatccgttccaccggtactccgaacatctgggcagctgtggcctcgtaaatctttccatgggtggcaaacacctcgttcacccactgttccccagccagccaggcaatcacgcgggcctctatggcgctgaaatcagccaccacaaacttgtggccttcagacggaataaaggctgttctgataagctgagagagcgtgtctggcacgtttccgtagagtagcttaatcccgtcatagttcttagccttcaccagcttccgggcatagtccaaagtcttgatataatttctgggaaggttctgcaactgtaccagccgtccggcatatctcccggtacggttggccccgtagtattgtgttaatccgcgtactctgtcgccctcaccgcgagccgtgttcatggccacatatttcttaatggaggtcttacccagctgttgccgaacttcaagcatctgacagacatcttccggcagattccccttatcccttaacaggtcctccaccgtagccttctgtaggttattcagcaggtcagggtcatccggatgctctttagaatgacggttgagccaaggtaccagctgctgctggctgttcgggttctgcagcccggtcaggccgatggcctcgtccgtcagcttctgggtgctgatgccgtctatgtacagcgccccctcaatcagccctgtatccacccggacaccataagcattcatgagaacatccatctgccacaggcgttcctcttcctctggcatcgggaacaggtccagccgcttcagtatctcatgttctgtgactacgtcttgtttgcagtattccttgaacagggcccatttgtctgcatcatgccatggctggttccatgtccgtcccccattggtcctggttggcttgcagggtacacagaaataccgtatcagagtcttgccgaccgcaagcttctgcttgtcctgcggcagcccgatggcccttcccgtggcatccaggccggcggtgtatccgcagtacaggccgtgggccatggtgcagcgccactgctggatcggtgtctcataaccggcgcggttcaggcagtaccattcgaacgccgcgttataagcgtgcttaattacattggggtccctcagggcatcttcccatatctccggtgggaatgattcatctgccgaaaggtctatgacctccaccggcccgtcgtcccactggtacgcaaacaggaggattttaaaatccggggactgggcgtatttgtaagccccggccttgctgatatccacgctgctgcgtgtctctatgtctatgctgagatgatgtttcgccatccgtcttacctcctgtcaggttgaggggccgcagggcccctcttgtagtcatcaatacggcatccccgtgattgggttgacagcagcagacgtctgcgcccatggagctgtttgtggctgcggagcataacctgcggctcctggagttgccggcatggctgctccatactgcggtgtggctgcctgtggtactggtgtcccaaaagcctgtgcggcacttggcgcgctgcctcccagggaatcaccgtctctcagcttctgtaccggccccaggccgcagccaatccccttcttaccgccaaaggcataaggatagaaagatacattcacgcgcccatacataccgctgtatacctctgactggttgataatggggttccccatcttatcaactatctcaggcggataatctgccttggcactggccgtgaacacccaatggcccttgcactcaggcccaaaggccatgccatcggatggcctcacgccatccccgtcatagaccggcactgggacaattggcgggcactgtccgttccacttttcgctgataccccgctgcttcgcggcctcaatggcagcgttaatcctccccatggtgtccatgtccgtcttcggcaccagtacggtcacctggtatttctcctcctgccctggctgataagcatagggcttgaacaggtgtacataagacagtcttgcttccccggttgttacgtttgttaattcattcataataaaatatcctttcatctttatattgtgggctccgtccccttggtttataatcaaggaaaaggaggcgtttttatgagacaaattgataagcttctacaaacccttggcgaaccgtatgatatccaggggtttgatggtgaggactgcatccacaggaaatttggaaactacgaatttgaggtttctggtacgggccgcagacattttgttctgtatgtatggacagtctcacccagggtagtggtagcgatatataagaatatcctaaccgaacacatcaaggatgtcctgggctattatgcttccatataccaaaacattccggaccaaatccaggtcgaacgccaagatataaaagtatgactcccaaatcccttctggaaagtttcctttcttcgatgacccggtcaagttcttcaatgtctcgagggtcctccgtttttaattcaaatcttctgagctcgcccagtgtacggctgcggggcgggcttgtcttaacctcatccacatttagccctcctccctgaacgcctccgcggcgctcactttattagtgattgctggccgtttatctgtttcttctactaatgccggcttccctgggttcttgacgaccaatccgcccacaagttcctggaagtccttcttacctaccaccttctcgacctgggccagcgaaagtggcttacgctcccacaggatagtgtctgatatgccattcgatgtaagcgtactgaatgccttatccatgtcggtccagtccctggagccgcgtccctccacagccttccaaccgggcacttccttcccggccaggcagtccgccagggcaacatcctgggcatcactgtaccatttggcaatgtccttacctttcataaggtactggcccagttcttcatttgtgaggagttttgggtctgtccccaccagaaaggccagttccacgttcttctccgcacgggccttgcatcttcctctggccctgcagtacctgcatgtctttggggcgggtgcgaattcaccttcacccttaatggccagtgctgcccgttccttgacgaattccccgaactgcagcatctcatccagggtacactcccattcagatatgccgtccgaaagccgtggctgcacgatggacagcctcactgtcttaaacgtataaaggattctatacatctcatatgcacccaaggcatacagcagcatctgcgggttccattcggccgtcacgcgtccgtccgggctcttgccatacttgaagtcaatgacatgtaatacatcgccccctatcaggatgcagtccgccgtcccaaatccctccggtacgtatgtacttagatccacccgtttttcaatcgccacataagggctggaaggatacttcatggccacagccttgatatagtccaggtaatcatccgtatagcctgtcatctcgtcatcccacagttcttctttcttcagcttgttgacagccgccgtcagcttccgtttcccaaaatcaactgagtagaagtaatttctcactttaagttccgccagctcatgggccaatgtcccctccgccgctgcagtcccggagggattgtccgggaactgctcttggagcctggcgctgggggtacaggccatccactgataagcgcccgaagcacttaggagtgcgtgggccctttctgcgtgtccccccatcatatctgtgcccccagtccacggagcgcggttgcaaacgcaccataccgctccggctgcaggaacggcagcgcctccaccccgaagctccggataagctgcagcagctccggctgcttgcctgagtccataagtggaatggctgccatcatcaagtcatccagagtgtagtttggtgcggttgtggccaccggctgaaccggaggggttactgtggctgcgagggcaggctgctggacaggcggtgaagtaacaggcgcctgttgcaccggtggtggggtgacaggcacctgctggctggatgccgtcgtaaatgtttccggggtaatccccaaaatgttctccgccgtgggcctctgggatgcgttgtcgctggaaacatcctgtcccatcaccttttttgcaaagttcatcatgtcctcataatcttcaaatactactgtcatagtcatagtcttaatcctccttgatttttccgccataatcccttatactaagggtgtgctaaactatttgtccatgggcctcttgcggttgccgccgctggggtccatcttcatttcttccaatatctcattacttgctgcctcggcccccgcctcaatcctatctgcgttaccggtcataacaacaccagattggaccatggcctgtatgatgatacctttaataacttgtctctgtattatcctcatctcctctcacagcctcacacccatggcaaccgccattattacaatagctaccatccacatccccagcagccagataaccgccggcacaatccatttagctgccatcatgattgggctgtcccggcgcctcctgcaccgtcggaaggtcaccatacgcctgtgacccatgatattggtcatcaccgcggttgccggtcccacaaaatccacacgccagccgggatactggaccgctgctctggcgcggatgcgatgctccgcaaatgttttagctctcattggcttgtctctcctttctatgcttgtcctccatggccgcccttaggcggtctttctcttccttcgaaatcccagtggaagcatcagattgtcctgcagcgcataggcaatgcgccgtttttcttcatccgtcagtgattccattggaacatcctggccatcaatttctatgtatttgaatacttttaatttctgcactatcaccacccctccctggtagattgtatgcggtaccggttgtacttgtttccttcctctcatagtccttgcacggataccaccgtgtccgttccgggcactggctatgccgacaggtcttgcaggtcgtgttaatatgtaccgcctccctcgttgcgttttatccccctccttgttatactgtacttacaggcgttgcagcgccgagtacaaaacttatacctatatatcaggaggagatgtctctatgttttcaaaagaacaagaactgctatcatcggtttatcaaaactatcttgaaaccggaaaacgcgaatgcggtcttactttttccaatcttcaagataaatcagaaacctatgatattctcgataatctgcgtgatgatggatttatcgaatatatagccagggctatgggattttgtcagttcaagataacaacttatggaatccagttctccaagaatggatttaaggagcctgaactttccccctcaatccaaggtgacaacaacattgtaatttccggatctagcaacactgtttctggtaactacaactctatttgggtcgatattgcaaactccgatttacctgaagatagtaaaaaaattatagagtcattcctttacgaaatgcgtaatcctcacctgactcctgataaaaaagaaagtaaaatcaattcgtttttatctgatatttcatcaggcaccatatccggaatcgccgcttctggcatatcagctcttctcgctgcgcttcttaaccagcttcatttttaaccgcatcagccgatacgtaagcttctctttcagcgtaccggctgaaattttgaccaagatcggttccatacattgactttctttcttctttttcaagagatacacttttgtcagtcgagtagcattttcaacaaaaagcgaatactcttctccctgaacttcaaaaataccctttatctccaccccgctccccctcctttccccataatcccattgacacataggttcgatagtggtatattcttcttatcgaacgtgtgtttgttttctcttattttatgtcacattttgtgtcgttactgttaaaaaaaatagcctggacacttttatggtaatacttagcgatacggatttttatttcatctcgcggtattctactaccattttcgtacatcgacaaagcagatttactgactcctacggcctttgcaacttcttcttgggttttctcacctcttagttgtatgagacgtttagaaatagcctcggcatccatatgcatacctcctttccacattgacacatatcgtgtcttattatgttataccattgtttacagtccgtgtcaatatctaaactgattttttattacaaagtgtgtcactctttctttacattgtttacattatgtgatattatttagttagaagtgaggtgtgaacatgggagaatttaataaaatttttaagtcgctacgacaaacacgtggatattcccaagccgaattatcggaagcattggctatttcaagaagttctatcagcatgtacgaaaacggaaatagagaaccagattttgagactttagaaaaaattgctgacttcttcaacgtggacatagattatcttttaggacgaaaaaagaccactactattctgtctgagaaaaagacatatgagccaacatatgaagatatccaaagccttattgcacgaaacggaaaaaaactcacggtcgaacaaaaacaggatatcattagaacgttattgtctgatgatgactaaaggagtgattttgtttggaacggcgcgagatttttcgtattattttagatgtatacgaaacctgcgaaataaaagagtttcccatcgactgcattgatgttattaaaaaattaaaaatccctttgtataagtattccgaactttctgccaaaaaggaaaaagagtgttatagggtaagcgacgatgcatttaaacttaaagggaaaatctattataatgattccttcccgtatatatgccggcaacgtttcacgcttatgcatgaggttggtcacatattattaaaacatgttggtgataccaaagaaaatgatgacgaaacaaattatttcgccagccattttttagcaccacgtattcttattcacaaatataaatgtcatgacgcaatccagatacatgacaaatttggtctgtcctatcaggcatctaacagagccttgatgtcctacaaagaatggttccgcaatatctcctacagcgcaaccaggaagcccacagagccggagcagcagctggagcatattttctttccagagccaaacttgattccgctcatggaaggtattgttcaaccggccagagaatgctacaccgaaaataacgaggaagaactggatgaacgttctaattttatgaagtttttaggcagatggcgcggggacctgggatttggaattgctgaagataagtggctttacggtaatgatttataagaaattgcttattttaataaataaacacatataaaactaaggaggattagcttgtgaaaaaaatgaaggtatttattacatccgttcttctatcatctgcgttaagcataactgcactggcaggggaatggaaacaggacgatattggatggtggtatcagaatgatgacggaagttatacaacagacacctggcaaaatattgaaggaaagaactatctttttgatgctaatgggtatatgagaactggatggatacatactgtcagcgggaaatggtactatctcaatcccactggagaaatgaggtatgatgatttaacagaaaatggtatcacataccacttcgactccaatggctattgcacaaatcctaataatgaaagtggctttgatagtgactaccagtccatattaaatcaagaacagcttgaagcacaaaaacgtcttttagaccagggaacatcaacaggaaatgcctatgaagaaaacatagtgtacgaacacgatgccgcaccgcaacctataaaaaataggtttcctttagctgatatgcaattctagtcataaaaataatctaacgaggaaatgaatatgggaacacaagagtcttattttgatggaggacttctccaactaattggctggaatttgcttggagcaatcataacattccttacctttggtatctgttatccttgggcattatgcatggtatacggctgggaaatcaagcacactgttgtcgaaggcagacgtctaaagtttacaggaacagccatgcaacttttcggtaattggattaaatggttactcctttgtctggttacatgcggcatctatagcttttggctttctatcgcattaaaaaaatggaaagttaagcatacagaatttgcggactaaacagtaaaaagcccctggagccgcgaactcccgcgctccaggggccaccaccttgacaataatatccttacccgggcagccgggagggcgtgcgtgccattcgttctgagtcttgacaggaaggatggttgcttatgagtacatatgaggaatttcagattatattaggcgttgccttgttaatcgttgcaatcctgaacatgaaaaataagtaagccgccctgctccttggccggatgggcgacttactaaagttgttataattcgccaggacggataggcttaatctatctcccggctgtcttgttaaatatattatatcaaatatacggaaattgtcaaatgtgaaaagcggccctgttaccagcaggaaccgccctcacatagttttctcttaccggaccattccggaagatataattaattaccttaagcaagtaaattatatcattcctggagcgtcctggcaaggggcgtattttttataccctttttttcaaggctcaccaaaatcttacaggctgtaatatgggttataatatgggccgaaatgtggattgaaacgtcctccaaactcatatacatgataggaacaggagatgatataatgccagcaacaccactagaaatcggcgccgcctacgtccgtgtcagcacagacgatcagacggagctgtctccggatgcccagatacgcgtcatcatggacgctgccaaggcggacggttttataattcccaaagaatacatatttattgagaagaaaggaatctccggccgcaaagcagacaaccggccagagttccagcgcatgatagccattgccaaatctcagaagccggcgcctttcaaacggctctatctctggaagttctcccggttcgccagaaaccaggaggaaagcaccttctacaaaggcatcctgagaaaaaaatgtgatgtagaaatcaagagcgtatcggaacccatcatggagggcatgtttggccgacttatcgaaaccataatagaatggtttgacgaatactattccatcaacctctccggcgaggtgttgcgcggtatgacggaaaaggccctccgtgaaggctaccaggccaccccctgcctcggctaccgggctgtcggggaaggcaagcctttcgccgtggaggaaaaatcatatgccatcgttgaatatattttccagacctaccatagcgggaaggatatgaccgccacggccagggctgccaatgccagaggataccggacccgccgcggcaacctattcgaccgccggggcattaaccggattcttgccaaccgcttttatattggcgaggtcatatggaacgggtattccttccagggcacccacgaggtacgttcctccgttacctccctatttgacgatgttcagaagcggattgaaaaggaataccggccccagaaacgccgggaggtttccaacaatgtccactggctttccggtctgctcaaatgcagcatatgcggcggcagccttggcttcaatcgttccaatgaccagaagaagcggcctgacttcttccagtgctggaagtatgcaaaagggatgcatccgggttcctgctgcctggccgtacacctggcggaaaaagctgtgattgaatctctggaggaagtccttgaaacaaatgaactggaatatgaatacatccaaaaaaccgatgatgctgtaaacgcagaagaaatcgtcattcaggaggcccttgcccgcttagaagtcaaggagcggcgtatcagggaagcttacgagaatgaaattgacaccctggaggaatataagcagaataagctccgtctgaaggctgaaagggaagaactcatggctgatgccgaaagactccgcaggcaggcagaacagtctcctgccacggttccaagcaaggaagatatcatgcgccagattgcgcatgtgcatgagattctggcagacccaaatatcagttatgagataaaagggaatgccctccgcaagatagtcaaagagattgtttttgaccgcggcaaagggcatttacatattcatttttatatatcataggttattgcagtccggcccgccatactgactcattataaactgagccatctgggcattgggctctttgatattaaccggaaattccaatctcttctcataaatccacattaatagcaccctccttcccatggccacggatcattaatccaggaccaatatgcagcatctgtattagcggaagctgtcaaaggtccaaactgggcttcaaaagctgctgctgcatttctgtatgcgtttgccatctgattatagtaatcaatggcggctgcatcacacggatgggtgtcaaggtagagattcgcatcaaccactgcaaagccggcctggtccacctcacgaagcatggcctcacgggaggcgttaaagtcgggattcatcatctgattcatcatcttccgcacctcccgtaattaaactgcaaatccaggtcagggaaaatagttccctggacaaggcctctctcaggggcataggtggtctgccactgctgccacggcacataagccatggccaccggatactgctgttccagtacgcctccctctgtagagggacacgacatattggccggttttgtggccggggctgcgggggtaggataggaaagcgcaggattgcttccccatgagtcccatggaaatgcgttcatgtccggataatccggatttgtataagaaccgcatccatttccaaacgatgcaccgcaagacatacggccgcggccgcagcactgggtacttacatctgtataagaatccataggttggatactccttccatttatctttttctactatagtttatgagaagaaaaacaacgggtgacaataaaatacatagagacaatcactcacactttgtctgggcgtcccatatgatatagtacaaaccaacaaaaaaggagagtgcaatatatgtgttgctttagattttgtagatgtggatggaaccgttgtaattgtggatgtggttgtggctgtaacaacagtggatgcggatgttcctgcggcggcagtaacagcggatgcggatgctcctgcggcggcagcaacagcggatgtggatgctcctgcggcggcagtaacagcggatgtggatgctcctgcggcggcagcaacagcggatgcggatgctcctgcggcggcagtaacagcggatgcggcggccatgatatctgtgccggtgccagacgccaggcatacagggaaggcttccgcaatggctattgggagggctttaacgatgcaacctggggcaatccgggatgcggcggccctaccccccgcacagccggaggacctggtccagctatcgccgaaagcagctgcggctgtaacaactaatatgaattgataaacaacaggtatgcggaacaggacctccctacgaggccctgttttttgcatctgtgatgttctttatccccctcttttctccccgcactcccccatacataacagacaaccattgacaatcttcctttttctggtatatagttggcttatattcattatcaattcacacatctaaccacaggaggtttggcatatggatgcacagaagctggaacagatacaaaaggtctttgccaatgaccgatttgccacggataacggggcagtcattgaacaagtagatgagggatatgcaaaatgttggttggaaatacaaccacaccatctcaatgcagcgggcacggtcatgggaggcgccatctttaccctggctgactttgcctttgcggttgcttccaactggaacaagccccttcacgtctcaaccacatcccaaatcacctatctgggtgttgccagaggcgcacgacttatagctgaggccagaaaggaaaaggaaggacggagcacctgctactacctggtggaagtaaaggatgatctgggcaacgaggtagcccatgtgaccgccagcggtttctccaaaggatagtcatgacaccgggaggtgacttatgatcaaaaaagactatacccgctgttggaaggcggctgaccgccgtgaactgcatttaatcaggctatgggaagaaacagcgcttaaacagcggcttttgggggcattattgattatttttatatttacgcttctgtatatccttatggttctaaatttgcttaagcatatagaatccatatggaaaccggccctgctgtacttaatcattctggcaggagtgtcattcgtatggggagccattatctatgaggatgaaaaaaaactgtggagcggcagattttataccagaatcgtcacctgcatcgggcatactgaaatcaatacccgttacaacaccttctactctctggatattttgggggaggagggggaaatactggagaaagtggaggtttccgctgctgtcttaaaggccgcgaaacaccaggataaacttctggctgccacccataacccggaggaattaagaccgcatatcctggtccctctgtccaagccgtccaggtcctgtttctggtacatgtgacagcaataacgcaaaggtgccgcaccatctcagatgattgtgcggcaccttcattctacccttcacttaccactcacttactccccacttcggctctcagtcctgtcataccagactaccagcacatctcctcattgctgtacagcaccaatccgccgtctgtcactgccctggcagctgtctctccgtcagatgccttcacaatcattgccctgcggttggcggaagccagtgcgtacatgtactcaatgttcagcccctggctgcagagaatgtgggtcatcttgtgcagttcacccacctggtcctccagttttactgccagcacatcggtcagcatggctgaaaatcctttttccctcagcgctgcctttgccttatccggatcagacacaatcattctcagcataccgtactccgtggtatccgccatgctgagggacagtatgttgatgtcctgctccttcagtacttctgtgacctgctccagtctgccttcacggttttctataaatacagataattgttttacaaacattcttgcaccccgccctttcttaattcagattcctcttgtcaatcacatgcttcgttttacccatgctccgctcaatgctctttggctccaccagctttaccttcacagccagacctatggcctgctgaatcatataggcgatctttcctgtgagattctccagctcccggatttcatctgagaagaatcgctcctccacttccacctgcacctctaaggtgtccagattgttcacacggtccacaatcagcaggtaatgaggcgtggtgccgcccatttccagcagggcagactctatctgggatgggaatacgttgacgcctcggataatcagcatgtcatcggtccttcctgtgaatctggcaatcctggccgtggtccttccgcactggcaggtactgtgatcaaggctggtcaaatcctttgtgcggtaacggattaaaggcagcccttccttggtcagggtggaaataaccagttcgccggtcatgccgtctctcagcggcttcaatgtattctggtccacgatctccggcaggaaatggtcctcatggatatggagtccctcatggaactggcagtctgtggcaacgcccggtcccatgatttcgctgaggccgtagatatcgtgggcgtggattcccagctgacgctcaatctgggttctcattttctcagtccagggctctgctccgttgatggatgccttcagtttaatcttatccttgacccccatctcctcgatggtttctgcaatatgaagaaggtaggacggcgtacacatgattcctgtcaccccgaaatccaccatcatggtcaccagcttcttggtgttccctgtggacatggggaccacggtggctcccatctcctccgcaccatagtgggctcccaggcctccggtaaacagaccgtatccgtaagccacctggatgatgtcattgcttcccagtccggccatggtaatgcacctggccacgcactcactccacacgtcaatgtccttgcgggtatatcccaccaccgtggactttcccgtggtgccgctggatgcgtggatacgggtaatctgggaattaggcaccgcaaacatgccgaaggggtatgtatctctcaaatcatcctttgtggtgaacggaagcctttccaggtcctcgattccccggatgtctcccggctccaatcccactgcctgcattttcttgcggtaatactccacactgtggtacaccctgtcaactaattttctcagccttgcgctctgcaggttggtcatctcatccctgctcatgcactcctttgtctcattccatatcatttgcctgtaacccctccaactctcacatgacatatttttatatcccttatctgcttacagtccactctccggtttacttcccggcttctgtccgactggcttctgtttgaccggcttctgtctgtctaaacagaaagcgcataaccggtctcaaatgcctttttattaatttccaccgtcttaggcggaaccgttgtctcgattaccttcagccagtcttccttctcaaatcccatgtgctttgcagctgctcccaggacaatgacattgaatgccttgggcgcgcccatctttttcgcttcctccgtggcctccaccacaatggttctgcgggcttcctttaaccggtcaatgattccttccggatactgagccacccctgtcaccaccgtaatagggtcaatgcgccagtcattgacaatgaccacgccgtcttttttgaggaaatgcagataccgcagggcctccagacgctcaaaggcaatcagcacgtctgcctggccttcctctacaatgggttctgccactttttctccatatctcacaaaggttaccacgctgccgccgcgctgggccatgccgtgcacctcggacaacttcacgtcaaagcccgccccgattgcaagctttccaagtatgcggctggtaagaagggttccctggccgcctacgcctactatcataatattctttgatgtcattttattcacccgcctttaccagattgattgcgtcaaatttacacagctgtttacacagtccgcagccattgcacatggtctcgtcaatggatatggtgccgtcctcattctttgtcagggcaggacagcccggtcttaaacaagctccgcatttcttacacttatccggcagcggcctgcacttgttggggaatttgattcccttaagcagggcgcagggcgccttggtgatgatgacggataccgcatcccttgccacttcctctttgattacgcgctccagctccgcctggtcaaaggcgtccacctcgcagacatgctcaatgcccagtgacttgcacagaccgtaaatattgatggcaggaaccacctgtcctttaagtgtcttgcctgtggcggcatgatcctggtggcctgtcattcccgtggtggaattatccaggatgatgactgtgccggcggcctggttgtagaccatgttcatgagagagttgattcctgtgtgcatgaaggtggaatcaccgattacagccacccagctcttaatatactctcttccctttgccttctccatgccgtggagagtgctgatgctggctcccatacagatcgtggtgtcaatgacgcttaagggcgccactgcccccagtgtatagcagccgatatctccggcagcatgtatcttcagcttgttaagcacagcgtatacgcttctgtggggacatcccggacacagtatgggaggtcttgcaggaacctgggccgccttatccacctgtgatgtctggcccagcacacgctccctgatcaggtttgcgctgtattcgccctgaaccgtgaatatttccttgcccactgccttctgaatgccccaggctttaacctgctcctccaccaccggctccagctcctcaaatatgtaaagcttatccaccttggccgcaaattcctcgatgagcttccttggaaggggattgagaagccccagcttcaggacagacgcctggggcatggcttccttcacatactggtatgcaataccgttggtgataaagcccacggataaatcattgtattccacccggttgatgggcaggctgttggcatcctctgccatttgtttcatgcgcgcttccaccaccacgtggcgtttgatggcattgccgggcatcatgacatactttgccatatccctctcatagggaatgtcaaagggctctgccctctcctccagttccaccagcccctgggaatgggacagacgggtggtactgcgcagaataacaggggtatcatatttctcactgaggtcatacgcatatttcatgaattccttggcttcggcactgtcggagggttccacaatggggaccatggcggctctggccaccatccggctgtcctgctcattctgagagctgtacatgcccgggtcatctgccaccaccagcaccagtccgcccctgacgccggtgtatgccgccgtatatagcggatccgcagccacattcatccccacatgcttcatgacgcacatggagcgcacgcctgctatggatgcaccgatggccacctctgtggccaccttctcattgggagcccactccgcgtaaatctcatcgtactggaccagtgactcgctgacctccgtactgggggtcccaggataggctgcggatacctttacccctgcctcataggcacctcttgctatggcttcattgccaagtaatattcttttctctgacacgttttttccttcctttcagtatgtattaaccgcaccggacctcttaaaaactgtcctgatgcctcatcagacttcctttcgcaggtccgtgaccctctttgcctttccctcaaaccgctgaagggtgttgggggataccagctgaatcttggcatccagaccaagcatcaggcgcatcttatccttcaaagtgtcctccagccgctcaagggcagcataggagtccatcatactctcagcctccacctcaaccttgataatcaggatatcggagtggttctttctgtccaccacgatttcatagttaggcccgattccctctgtattaatcagcacttcctcaatctggctggggaatacgttgacgccccgaatctttaacatatcatccgtacgtcctgacaggttctccatcctggcggtggtgcggccgcaggcacagggctcatacataagcctggtaatatccctggtacggtaacggatgagaggcagcgcctccttggaaatgcaggtgatgaccagctctcccttttcgccgggaggaagcacctcccctgtggcggagtctattacctccgcaataaaatggtcctcattgatatgcattcccttaagttccaggcattctcccgacacgccgggacccatcagctcgctcatgccgtaattctgggtcaaatttacatcctctccccataccttgtagagctcattcctcatggcctctgtcatcagctcgctgcccagtacaagagtctttaccttcaggtcttttctgggattaattcccatctccagggccacctcagcaatacgcatggcataggagggagtggccaccagcagggtggtctcaaaatccttcatatacatcagctgcttctgggtattgccggtagaggacggaaccaccgcagcgcctaccttctccagtccattgtgaagtcccagggcgcctgtgaacatgccgtatccaaaacaaatctgggccacatcctcgtccgaggcgcctcctgccacggccagacgggccacacattccttccacacctccaggtcattctccgtatatcccaccacagtgggctttcccgtggtaccgctggatgcgtggattctgcgcagttccttctttggaaccgcaaacaggccataggggtaattgtccctcatatcctgcttcgtcacaaacggaagcttctgtaaatccttcagtgtctgtatatgctccggccttacacctgcctcctccatcttggcgcggtatgccggtaccttttcataaacccggttcaccgtgtcttttaggcggctcagctgtatcgcttcaatctccgccctggacattgtctcctcttttgcccaaatcatgttgtctgacctccctttccctgcacccgtatctcctgtctggtttcctgtactatctcactttgacgtgacaacgcattggcgcattatattgtctggcgacattataccatcttttcccggatttgtctgctgttttcatgcaaatttcatatgagttttctgtttgcggtttttacagcggaagcatctgcacaaaacctaacagcagccataactacatcttatcacagtttcatgacttaggccatattaggacgtatattaggacggggacatattgaccatgtccctgtatattaacagggaaccatgtctcccgccttatggcgttttccatggttccctgcaatcgcacagccctcactgtgccggacctccctgtccctctacaccaggactccctcctggcttcgcagctttaccactgcggacaggtccgtctttttatgttcctttccgccctggtcctgacacttcttggaacgttcctcggcggtttcgcacttctgataaaaatatttgatgatgtcctttctggtaatgataccaatgaaactcttctgatcatccagtaccggcacaaagttctggttcaatgcctttccgatcagatcctccatatctgcgtctgctttaaccggacggttgtcacaccggcggcgtatggctgtgacaggtatcctctcagcccctttcagatccagattgaactggttcttgattccccataacagatcaccctctgtcagcgtccccacatagcgccctgtcctgctgacaatcggtaccgcggaatacttgtggtgctccattttctccaaagcctgccttaacgtatcatcctcacttatatacgccacgtcacttttaggagtcaggaaaaacagtatgttcattttttcactcctttttcccgtattcttaattaagtataatgcctgcctctgaaccgaatgtgaacaaattattataaaaatctgaaatttcttaagatgcaggaaatatagatatatttatatgtgaattaaacctgcccctacttcccttccccatacaaattcctatactgccccggcgtcatattctctgaactcttaaacctccttgtaaaattggacagattggcatatcccgcctcctgggctatctgggctatctgcttatctgtatgaatcagacaattcttggtgtaatccagacgttttttggatatcagttcggagaaactggtattcaggttctgggtgatgaatttactcatatagctggatgaatagccaaagtgttccgccatccccaccagacagagactgctgtccctgtaattatcttctatgtacgcaagcacctgctcagccaaatcattgcgggcgtcctgcctggaagccgcaaggatgccgctgattcttgcaagagcgtctcccagcttttcaccgaattcttccacggtcctgaacgcagtcagctggtacagctccttctctgtcagccggatgtcatttttcttcacttccttcaggagatggcttacgatatcataacagcacatcagcgccatctgtcccggaagctcctccagactcagcaccacttcctgcacagagccctccacgccctctggcgaaccgctttccagacaccggctgatacacaagagacattctgtctgatagcggctgatggtagcgctgtactcctcgccctttccctgctccatgctctcaaaatccagctccttgtggggatttagcagacggaacttcatgctggtaagagcctccagataggacaggtgcacacctgacgcatcctcatgaatatatcctgcggaaatgacgcactcgcaactgccgaatacctccttcaggcgctccctggcctcgatcctgtgttcctcagtaaggaccttgcggctgagaatgacggcaattgccccgaaatagtacaggaaacttgtgtatacgccgtaatccgtctggaactttgcttttatgggaccttccttctccttatagaaggcggataactccctggaagacatgtttcccccggccgccagaaccaccatatgattccgccccttcatctgttctgtcagaatgccgttcaccatgtcgtcctcccggatgccgtcctcccgggtatcgtcctccccatagagcagctttgtcacaagccgttcctccaccaggggccactgcttctcaatctcctttgccagggaatccttgacagaattcaggctgtcatactgattctttataaataccagctcatccctactcctgtcctcactgttttcattgtcctgcttcatatattgagccagccggtgtattggcttgtaataatggtaggccatgtagattgccataaagcatcccaggattaaaaagattaaaactccggtgaccagcaggctgttattctgtaccacatctgccagcaggtcgggcatggttatcttactcaatatgataagagagggatggtccatggggtatacgatataacggccctgtccggctccctcctgaaaggtggtgcagcttcccggaactgcctccaggacccgccccatcacctcatccagccctatatcctctccttctgttgccagtatcttcccctctccgttcagcacagcgatcccacggctgtagctgcccggggacgtggtcatactccggctgattttggagggctgcagttccagcaccacccaggattccaccttataggaataattatataccggataaatgaataccatctgcggccttgttatgattccgtccttcatatggtattccttattgataacatcgtaaccgggatgagccatatcatacagtttgtccagaaagggctgcctttcttcctccggcagcctcagctggcctgccagaagaatatccttggcataccggccctgggaagaaaaactcatatcttcattttcataaaggatatatgcctttgttatgtagggattggctgcattttcctcgcgcagcatgtccaccatctgaatctggttttgggcatccctgcttctggataccacagggccgctgaagctgattcggtttccggcctccataagacggccgttcatggttaccaaatcatcgcccaggcgctccagaatattttcattgtacccgagaatctccctggacagattgcggtacataataatttgcaaacaaatagaaagcaccaccatcggcaccagaaaaaacgaggtaaaacccaacaaatatttatgaaaaattcccctgcgcaaatccgtccctccccgcttcatgtggttcttcacatgccatctttacattatatattattttttcatgattggaaaggagataaatgggcggagcgcgtctgcagcgccgtaaggaactcttctgccaaagcattcccatcagcaaaacaacaggaaaacgcatgctgcttcttacctgcgttttcctgctgttatctgtacctatatgattccataatcccgccgccccgacccccatcctgaacctgttccggaaacagccttacaccgcaacgcaaaacctgtcttatatccgcgccagaacttcattcaaatccaatgttccggtaccgtcctccagttcaaagtacggtatgccgatacctcctgcccggcgcacagattcatacatctcattctgttcccggaccgccagatactgcttcaaatccggaaggctggcagacaggttcttaaaatcaatgtccgcctgcttctctgtcagtttacataatgcatacagtgtgtcaggacataaatgacttcctattacagttactttcatgctataaatctccttttctatcatatgattctatttggtttctgctatagcggcttgtgccgcggcagtatttcccatggaattttctttgtaaatccgtttttccagccagtcttttccttccaccagcctggtcaccatcatggaagcaatggtatcgccgctggcattgaggcaggttgcggccgggtccaccagaaatcctatggtggcaatcagcgggaatgcttctgccggaaagccgaagagactgacaatgagcatttctcccaccaggccgcccccgggagcaccggatagcacaaaggcgctcaggatggcaaccgccatggccatggcataggtaccgattccggtaaaggactggccgaatataccaaacaggaaacttatcttcactatggaggagagcacggaaccatccatatgcatggtcgcccccatgggcagcacaatatcccggatgtcccttggtacccctatcttgtcacacgcctcgcagtttacaggcagggcggcaatggagctctgagtggcaaatgcagtgaccgcaggattcagtatatgtttgaacatacgcctcaccccctcttttcctccggcgaaataggaatatgccggaaatgctgccatgaaataaaggatgcacatgggataatacaccagcatggcatgtccgtagtctccgatcagtcccggaccgaactctcccaccagggatgcaaaatacgctcccaggccaatcggcgcgtacagcatgataatactcacgattttcatgataattgaattcaggttattgagcatccttcccacaggactgtcctcacctccgcaggcgctgacgcagaaaccggacaaaatggcgaatacaatgatgggcagcatgttcttcctgctcataagccctgaaaaatcgtcaaccgtcagtgcgcctaccaccatttccccgattccgctcatttcctccatctcagcgccggcaaaatggatgctggtgcctgcggccggcggaaatacattcactaccaccagcaccaggacacctgcgatggcaccggtaatcacaaataccatcaccagactgctcagtatcttccccagccgtttcatgttcaccatgttccccactgcgctggatatggaaacaaaaaccattggaaccacaatcgtaaacatcagattcagaaaaatatctcccaggggagccagaacctttgccttttcgccaaatatcaccccgatgacggcgccaatcatgatgcctgataataaaatgattggaaaacggtaattcttccatatttctgatttgttcatcccttacttcctccttctcctttggcgcagcccggtctacagactatccactgcgttctttaactgtcccagggccctctccagtacactccttgggcaggcggcattcagcctcatgtaaccggacaggctccgtccgaaggtatacccctcattcagtcccaaaccggccttctcgatcataaaggtacgcagggtctcattatccatattcagttcacggcagtccagccacacaagataagtggcgtccggcaccgtgggcttgattttgggtatattggcgctgcagtattcccttatgaaggtaaagttcccatccagatacgcaagcagctgttccagccactcttccccctcattaaacgctacctccattgccacggaactgaacgcgttatttctgtggacatccatagccatccagaagtcatcaaatttcttcttcatctccagattggggaaaattgtggtggatgcctgaagacctgccaggttgaaggtctttgtgccggaaatacagctgattacccttccggctgtctctgcggacaatgtggctgttggaatatgtttttttccatggaacaccaggtcagaatgtatctcgtcggataccagcagagtgttgttggccatacagatatctgccattcgggtcagctcctccctgctccatacaattcccagtggattgtgggggctgcacaaaaggaatattctggcttccttagccttggcttcaaaatcctcgaagtcaattccccatgcaccgtccttttccaccagtcggttttccagcacattccgtccccacgcctctgttacatcatagaattccgagtacacaggcgtctgaatcatgatgctgtcacccggttctgaaaacaactttacaatggatgacagggccggcaccactcccaggctccagctcatcatctccttttttatatcccatccgttgcgccgcttctgccagccccggatcgcctcaaagtaggaatccggcctggaggtatatccccagatcccctcttcggccctctccttaagggcgtctatgatgggctcagctgtcctgaaatccatatcggccacccataagggaatcacatcctccctgccgaatttcttcatcctctcatcatacttggctgccctgttgtggctcctgtcaatgacttcgtcaaaattatacttcatgtcatataccgcctttctttcattgtttatgctggctgcgcttttccgcgtctgcctgtgcttttccgcatctgcttgtacttttccgcatctgcctatttaataagcaagcatcatgccaacttttacaatcgtatcgaaatccacgcaaaaaaaggacttgattccctattaaatcaaatccttttacgctgtatttaaattattccgcaaaccaaatcaaatggttatattggtctttaattggttgtattcttttatttttggttgataatatggtttatttggttaaattcatacccttcccatatcttcctgcccagggatgttatacggcttccgcctcttcctcgtccgaccctggccaggccatattccctgaatattcccaggatagacctgacggccggctgggagagaaggagcttttcttttctggcagcttccagaatccgctcccgtcccactgtctctccattttcagaggaacagtataacatttttagtacaaaccagtattcctccggttccagcccctgttcccgcattgcctgtttccacagtgcggtatcaggctgcaaaaccggttcctgatattccgcctttttggatgcgcagtacgataatcctgttccaatcccatcatactgaaatgtggggggcaaatcctttacagtgatgacctggctgcctgtaaagcaaaagtactccgccaggttgcgcagctcccggatattccccggccagctgtacgtgcggaaaatcttctttacctcctctgagagcacaaactctcccttcagttcccggcagaaccgttccatgagaaggaatacatcctccccccgccggcacaggggaggaatgaggaccggcagtgtgttcaggcggtaatacaggtcccgccggaagctgccgtcacgcaccttttctttcagtgactcattggtagctgccacgatacgtacatccacgctgataatcttattgccgcccacccgcatgatctcatgctcctgaagcacccgcagcaattttacctggagggccggactcatgccctccacctcatccagaaacaaggtgccgtgatgggcgaattcaaacagccctggtcttccgcctttttttgccccggtaaacgcgccctcctcatacccgaaaagctcgctttccagcagattttccggcatagccccgcagtttatggccacaaacggtcccttttccctcctggaagccagatgcactgcgttggcaaacaactccttgccagtgcctgtctcgccaattaagagtaccggtgattccgtgtaggccatccgccttaaaatagcctttgtcctcaatatctccccggacaccccaatcacatcctcaaaggtgtacttggcccggtaccccttgtgcatcagctggttgcgcagctcatgctggcggttctcagcatcattgaagggctgcaggatggcaaacgcgccgatgcagtcctccctgcgcagcaccggaaccactgtgacgccaacattcacattgttgatgcggattactctgggctctatcttcttttttgtcttaaggcactcaataaacggcaaatacgccagggaggcagatgcctgcttatgcatcaccagcgtacggctcagccccgtaatcgtttccgccttcctgttcatggcaaatatctcggcccgttcattgataccgatgattccctcgtccaatatctccatcagtatgtcaaactggctttccagccttctggacctggcgaacatcatgtcaaaattgtaggtgctggtgaccacacttgaaaaatatgcctggaacttaggtgtctccagcagttcctccaggcctagctttaacgctacctcaatcatggtctccgaagtcagacagcgctgtcctatgttgaccacctgcttcacgctgtccgggacataccgttcttcgtccggtgtgacagccaggccaatgccctccaccggctccgctcccggataaaagggtataaattcaatgtggttcacccccagctggttcaaacccgatgtggcttcccggaccattttctccgtcatattcacaaacagtgccctggttccggcaggaatggtccgcagcagccgtatggtttcccatagataggtcacgtgaatctcgctgatctgcgcttcaatggggatgtactggggcacatcctcccggttgtcaaatgcgtctgttgacatgagatacagatccgcccgctccatattggaaatcgttccttctctcacactgtatgaattcaccttcacgtattccccgaacagctcctgcacctgttttccgtaaaatgcgctggctcttgggtccagggcaatgactgctacctttttaaccattttattcctccatttcaaccattaaaaccattataagaccaaaacccgcctttctgcaagctgaattttcaggcatgaatcttgcttgtaatgagagatagataggatttgcgctgaacgccctgtcattggtcagggctgcatggtgcgggaattgcaaaggaggaacatcatgaataaagaagaattgattgcattgttaaagcaggaggtagtgcctgccctgggctatactgagccagtgtgtgtggccctggccgcggcagatgccgcaaaggctgccggaggaaccattctgtccgtcagggtagaaatgaatccaggcatctataagaacggtatgaatgtaggtattcccggttttgaccgggtgggactcaaatatgccgctgccctgggcgcctgcctggccaatcctcagaaaggacttaaactcctggaggacctttcccctgctgtcagcagccaggccataaacctggtggaatccggaatggtcacacttaagctcaaggaggacgagcccctgctctatgcccatgcagaagcagtgtcctctgccggtacaggagccagcacaataagaaatacccattccaatattgtctgtaccgcccggacagtaaacggagttctcacgcctttctttcagaaggaatactcccttaccggcaggacggctctccatgaaaagctggcctccatgaccatttcgcagattgtatccctggtcgaaagctgttccccggaggaactggccttcatggaagacggagcccggatgaactctgccctggccgattacggcatgcagcacaaacttggcatcggagccgcctcctccctggcaaaatactgccggaccgatattatgggaaactcccttatgagccgtatcatgacccttatggccagcagcgcggaaggccgcatgtgcggctgtccctatgcagtcatgagcagcgcaggcagcggcaaccacggccttaccaccatactgcccgtagtggaaacagcccggtatcttggctctgacaaagagcatctggtaaaggcgctggccatatcccattccatcaatgtgtatattaaggaattcaccggcaagctgtccgccacctgcggatgcggtgtatccgctgcttctgccgcctctgcttccatggtctggctcatgggcggcagccatgaacagatgggatatgccatcatcaatatgagcggcaacctgaccggcatgatatgtgacggcggaaaaatcggatgtgccttaaaactggctacagccagcggggcagcccttatgagcgcctgtctggccgtggacaaaaccgtgctggatccaaaggacggcatatgccatgccacaccggagggcgccatccgcaatatgggacgaatcagcaatcccggcatggcgcagacagaccgcaccattctggaaatcatgatggagaaagattaatccgccctttagtccaccagcttatccagttccttcacatgttctgtctcattggaggttttatgctttgccttggatgcgtacaggttcacggatgcctgggacttcttaataggctgcatggttcccgctccggccacacatccgcccggacacgccattccctccagaaggtagccattgtatttcccggcctttgccatggtcagcagttttctgcattccttaaggccctctgcattggctaccttgatttccttatccggataacgctcatgaatcacatccactacggacttggccaccccgcctgccaccgcaaagttacggccgtccatggaagcgtcattgacgccttccggatcttcttctatcttctccacgtccacatgccgggcgtcaaagatgccgtccatttcttcaaaggtaaggacgaaatctacatcgcttcgtatgtccgtacgcatggcctccagcttcttggctgcgcagggaccgatgaatacaacctttgcattggaatggtgccgcttaatcagccttgccgtcagggtcatgggggtcaatgccatggaaatacagtccgcatgctccgggaacagcttcttagccatcatggaccaggccgggcagcaggatgtagccataaagggaagcttttccggcacttcctggataaagtcaattgcctcctgggtagcgcacaggtcggctcccaccgccacctcaaatacgtccgcaaaccccagcgccttcatggctgcgcgcagcttgccgggcgtcacctttggtccgaactgccccacaaaagccggggcaactgccgcataaaccctttcccctgactggatggcccgtataacctggaatatctgcgatttatccgctatggctccaaaggggcagttcaccagacacattccgcaggatacgcatttatcgtaatcaatatccgcctttccattctcatccgtggaaatggcgtccataccgcaggcagcggcgcagggtctttcctggataatgatggccttataggaacaaacatccgcgcaccttccgcatttgatgcatttgtcatcattgatgtgggagcggccattggtcctgtccagcttgatggcatccttagggcacacctcctcacatggatgggccagacagccctggcagccgtctgttacaaatacgcgcttttcatgacaggcattgcaggcaaatttaatcacattaatcaggggaggcgtataataagtctccggtctgtccgcagcctctatgttatccgaaaccggcgcatgttccgccgcactgcggtacggaagccccatggccaatctgagccgttccccgacaatggcccgttccaaaaaaacgtcattgcggaaattccccacttctcccggtatgattttatacggaagctcttcaatacgtttatccaccggccattccgtatgataggccatccttgccacttccctgaatatcctgtgtctgatttcctgtatacgtgtctccactcctcgcatattcctgcctccttgttatgagcacttagagaccgtcctttggtctcttacgtgcgatacattccgcttttaacagtaccgattatataccagcccatgaaaaatgcaaatgcctaaatgcatttttccccttttgttcttaaaataaagcacggaccgcagacaaaaacaggcgcgcggccgttttttcccggccgcgcgcctgttcatacgttaccattttaccagtctcaacacctcttccacaccgccatggtcattgtcacccgtcacatagcgggcaaggcgtttcagttcatctctgctgtttcccatggcgatcccccagccggcatactgtatcatctccatgtcattgtccccatctccaatagccagggtatgttccaacggaatgcccaaatggctgcaaagccattttagcgcggcgcccttgtcggcggatgcgtgattgatctccatgttgccttccatggagctggtcagcctcaggcctccccgctgcctcaggattccttccaggcactcccggtcctccgcctccagaaaaaacaaatttatcttctctgtttcattccaaaggtccgcagcttttgacaaatcgggaaccagtatatggtttctggtaaaataccggacaaaattataattatggtttatacgggatgcccgtatgctgtccccttcattaatataagatttcccctgggaaaacaattccgcatacccgtcccgtcctttcaggaattccaatacggttttcaccgttccttccggaagctttagcctgtataatgatgaaagagagcgcatactccatatctgtgccccattggccgtgactacatagcggacatttcccatcatcagcagattttgaggaatgcttttcagataccggccgctgcagggcaccaccaaaatcccctgctcgctcaattggcggattcgcctgattgttgtctccggaatatggtcattgctgtccatcaatgttccatccatatcaattgccatcatttgaataccatggatcacggtgtccatctttttatataatgtcatttcagtcactttctttcattgggttctgcattttgctgacacgtcacccctttcggctatccttctgccgtactccctcgtaccaccagctttaccggaagcaggatctctctcccccactccattggttcccggctttccaccatatccgccagcgtatccacggccaacgccgccttgcgcttcatatcctgacggacagtggtcagcccggggctggacagggaggcgtacagaatatcgtcaaatccagcaattccaaggtcctgcggtatcttaatcccctgatccctgaaatgattcatggcctccagggcatacaaatccgaaaggcagaacagggccggcctgaatccctccctgatattgttttttacccgccggacaagggattcaaaggtatccctgcgcttttcccggttcatgcccagggatataaaatgtacccggccgttcgcctctgccgtatcccccttcttcatccgttccttccatgcgccctggcatcccaggtatcttatatggtccacgccgtggtctctccctgcacacacataaacaggcccatatccgcattccaggagataatctgtcataagtctgccaccctgccagtcatccagaccaatgttgggaaccttgccctgatatccgctggcatcaatggaaaccacgggccgtttcagcaggccggcaatcttatcacaatcattcttatgaaagctcagggttatgactccctccacctcccgttctgtgaccatgcggaaaatgtcatccatatcagaggatgcgtaaaatatcatgcagtaccccttttccctcagatactgctctgtcataccgattatcttcccgtaaaaaggatcggcgccaatggcctcctcgtacgtcttatggggattggccagcaatgccaccagcccggagccgccaggccttttctcctccccggaaccgccccggacataccccattgtctgaatcagttcctgcacgcggcggatggtctcaggagagacccgcttggtttttccatgaataacattggacaccgtggccgtactgacccctgccgcttccgccagctcccttatggtgacacggccgccggacggcgcctccctgcccttttcctgcttcacatcattccctgtccccatgacctcatccatattaagcctccagcatatatatcctggactgataatccccgttggtaccgtcgtatttctccttgttgtcccctgaagatgagtcggacacaatgaggccgaaattcaacagttcatcgccgtacacgtcaatctctttaaatccgccatgataaccgccgccctgtatggacacatggtagcggattccctcttccaatcctgccagacggattttcctgtacccttcattcacaggctccaatatccggtaatatcccaccagagcccttttccggtccccggataccaccatccaggcagtcacatttccccttccctcaaagggactgattagcctgtaaaaggttccgaactggataagatcccggttctccttcataaaagcaatctgtctcctcactttttccagttcttcctccgtcagctgattcaggtccagttcatatccaaaggttccaaagcaggccacgttcgccctggtttcaatgggtgtggtgcgcagaacctggtgattcggcaccgccgacacatgggcgcccatgctgcttaaggggtagaccatggatgttccgtattgtatctttaaccgttccactgcgtccgtgtcatcggatgtccagcactggggcgcataatacagcatccccggatcaaaccgggcccctccgctggcgcatgattccagcaatatatgaggataccgcctgatcagcttttcatacaaactgtatacccccagaatataacggtggaataccatcccctgttcctccggacggccggctcgggaatatacctcggacatgcaccggttcatatcccatttgatataggagacaggcgcctcgtccagcacatgtcttaacatctggtaaatatactccaccacttcctccctggaaaaatccagaacgaactgattcctgccatggcaggcgctgcggcccggggcggacagcatccagtccggatgggccctgtacaaatcgctgtccttatttaccatctccggctctatccacagcccgaacgcaaggcccatttcttctatcctgcgggctattcccgccactccctccggcagctttttccggtagggataccagtctcccagggaggacctgctgtcatcccgtcggccgaaccagccgtcatccagtacaaaaagttccactcccacatctttggcggttctggcaagcttaaggattttttcttcgtcaaagtcgaaataggtggcttcccagttattgattaatatgggcctggctctgtctctccagggtcccctggcaaggcggctgcggtataattcatgataggtctggctcataccgttcagtccgctgtccgaatataccataaccacctcgggagtctgaaacatttctcccttctttaacggccaggaaaagcaatggggatggatccccagcatgaccctggtgacgtcatatgtatccacctctgcctgagccagaaaattgccgctgtacaccaggctaaagccgtaaacctcccctgcatgttctcctgtatccggccgtttgagggcaataaatgggttgtaattactgctgctgcatcctctcatgctgtacacggactgaacgccatgctccagcctccttgtctttacgttccgctccctggcccaggcccctgtaagctccaccatctcaaacacgctgtccggcaggtccaggctggcgctcatggcctggttcaggaccacgccgtcttcatgatcgcagatgaaccgggcgctccttgtgataacaggaaggttctcataaatcgtgtaagtaagaatcagttttgtctttatccacgcatccttcagggttatctccaaggtggaagcctcccgcgcctgttccgcataggtggcaggcagccccttaagggcgggctttccttcccggacacaatgggattcatagacaaattccgtgatgcggctcccgtcggcctggaggatgtcataggccggacagcgcatatcgccgtgtccataggatggatattcctgtttgatgtgttccatggaaaattccctgtccccttcataaaaacagggcgccatggaacgaatccgtatttccagcatatgctcaaaagaggcctggtccctgaccgcctttccatagtacagatggcccagctgtccgttgcgcagtattgtcatgatataacttatcttatgattatacaggtggaattcccttccgttcccatgtattttaattggcatatcgttacctccaatgattctgaccggctctagctcttttcttctataatgattctgcggaacagctcatagagcagggatagttcataggaattcatcctgattctgtatttctgctccatatcgctgaaaatttccctggataccccataaaaccgcttttcccgcggcgacagctcttgcggctgttccgtcaccgggtccgtcgtcataaggcgctcaatcatgaacgcaatatgcatatacaggttcagcctgatgtgtcccgtcatttccagatgatagtactgctcatacttcatgagcaccagctccacttcattgataaccacggtgggattcaggaacctgaggcggctgacaattccttctatggaaaagaaccggatgtattcacgtttcagttcctcgaatttttctccggacagcagtcccttaaacgagctccacagcagatcctcacccttgccgtccaggatgtcatagatgttcagccagggtacccttacatgttccggcagagccgaggtagtgaggatgagcagtgtctgtttaaaatattccttttggttctcatccaaaagcctgcgcagttcctggtaatccatggtcacgatatcaatgtcggaggggtcaaataccttgcacatggcctcctgaagtttttctgcaattcccacacccgacatgcaggatacgatgatattcctgcctctggacactccctcaaagtactggatttcaaaggcatatgtctccctggcagccctcacaatatctaaaaaggagcagcggcccagcatcttgatgcctacatccagcgcaatggccgtagtcacattattgataatcagcaagtctcccgccaagtcatttttgatggaagaatacagctggccgagggaaccggtgtccaccagaagaatcatgcccttccttgtattgacccgttccagatactgcctgacctttgttatggtatcctccactgccgtatccatgggcatgtcaatagcttcaaacacaaaggtacggcaggtgcggttggcaaccttctggatactgctggccgtggagtccccgtgtgcaacaattaatccgtgaaattccatggtctccaccatatattcatgaagggacagggaaaacaggaagttaagggctgttcccgcttcctggtccatctcatccagattccggcaaatccgccctgccacatagtacgcctttggcatggcctgttcaaaataagtgtccagttttctgcgtgtttcttcctccgggcagctgtatttgaatatactgtagagaaatcccagttcatccataaccccctttacctcgcccactccgtaggcgcagagaatttcacggcatatcgggctgaacagtttccagtccggttcactccggcagactgagttttcctgggttctgagttttttcaccatgcgtttaaagttcagatatacactgtccactgaagtctccacgcgctcaaaaggaatcccggaaatatcctcccacagggcatccatttcccgttttgccccctcacaggccagttctgtctgttcaaagggcagtccgtccccatccaccagaatggacggcagtccgcaggaccgtctggtccggtcacggctgctttggctgccccccgctatctcaggcagctcccccatggtaatgtgaagtatgtccttgtgccgctgacggtaaaatgcattggcacagctgacctgtaccagattctccagctttccgatatttccctgcagctttgtgaacagcaatgcttccgccactgttccgtccacctctatccgccggttgaccttcccagcctccttctggtaaaagagatacagcatttgaagccgctccttaagaggccgttccatcatgctgggaataggaatctgaagggtaatgcgccgtcggaaggtttccaaaagtacttcctccggctgttccgtggtggcaaaaatgaaacgtaccctggaggttttccaggcgttgtctcccaggggacggtattggcccgaatccatgaacaggaataatttctcctggttttcaaaggacagcctgtggacctcatccaggaacagatatcctccgtccgcttccttcaaaagcccgtcccggtcccggtcagctcccgtaaagctgccctttttatatcccagcaagacagcggaaaggagttccggattattggcgtaatccgcgcagttgagcaccacaaagggcgcaccggcggcaatggtctgctgttccagggcatattcatatatcaggcgggctataaaactttttcccactccgctttcgccggtcagaagcatgggaaggccgtccggaggataattcactgcagccatacacatctccacggtctgtctctgactccctgcgtatcccaccatggatgagaatacggaactaacggaaacggcagccggttccaccctttcccgggacagcccggtttccgcgcatttccactgttcttctccaaaaaattccaaatcttccgaagtcacgggaaaccagtacactggccgtgtactggtttttaccgcaagtccgtcctccatgagcctggtcagataatggcttatcacctgccggctcagattcagcttctgcgccagctctgccgctgttatctttccattgttgctgcacgattcttttaaggattcatagacccgttcttttgcctgcatggacaacccctccatcatactgattctgcattcctgttcccgtttcattccgtgggacataattattccccatatctattccccatcctcatacaaccatcataccatgctgtttcagcaggatgcaattcccaaactatgctattcccagtctacgctatccccagtctacgctatccccagtctacgctatccccagtctacgctatccccagggctgagagcacaattcccaggacaatcacacccacaatcagcacattgatgctcattttcttttttgtcaggagatagaagcacagcaaggtaaggcacagcggaaccagtcccacaaacagctggtccagcatactctggagggagaaaatctctgtcccctccatggacaatgacagcttgctgttaaataccaccatgctgctggccattcctcctaccatcataagtcccatgatactggccgccttggtcagcaccgtaatcaggcctccgctgtacagcttctcaatgtattcggaacccaggctgtatcccagaaacgttccgtagtagcgcactacattgctggggatattaaacaataacaggaacacaagcggcgccagtacattgcctgcctgggccatactgatggctattccggcgcagattacacgccatacaccccagaatatggaatcgcctatgccggccagagggcccatgaggctggtcttgatggggttaatggatcccgcgtcaaagtccttgttctcgctgttttccttttccatggcgccgcagagtcccatgatgaacgtggacatgggcaccgttgtattgaagtaggatatatgccttgccattgcctccttcttaccctccggatcatttttataaaaccggttgataaaaggaatcatagagtagcagaaaccggatgctccctgttttgccggggttacggatgtgtataaggtaaaggaacgcaggaatacggacctgagcattttcttttcttctctggaaacatcagttatcttagacattgaaaaaatcctcctcttcttcatctaatattccctgtgcaggaacagccgcaggcgcggcagcggcctttactctcagaagctggttaagctccagatccctctgcgccaccagcagggccgctatgacgcccagggcagccagcgcgatcagcggaagctttaaataagccaccagcacaaatcccaggaaaaagtaaacacagattttattgttccacaacagcttcaaaagcatggccatacctacagccggaagcaggtttccgcagaccgtaaggccgttcatgataaccgccggaatagccttaaccgctgcctccactgccttagagccaaaaaggattgcaaagaacggaatcaggcagtacagtccccagttcaggcaccacagtccatagtggagtctcgtaagctttttgtcctccccgttctcagccagtttgtcgaataccggagcgaaccagcctataataccaatccagataatgtttttcgcctgctgtcccagcattccgatgggaagggctaacgggagcgccacctcagggccgccgccgctcatgatggcaaaagcgcagcccaccacgctggcgattccgcattcagcagctgatgcgcctcctatgtttacaatacccatgaacacagcttccagggaggcgccgataagcagcccctgctgtatatccccaaaaagccagcctacgatgggacagatgaataccggacggtccagcatggtgaatcccagcaaatccctgactccagatgcgataagtaccatgactgcgataacaaacgcagtaacaagtatagatgaatgtgctaacatgaatttatcccctttctgtctatgttttacaacacttctgaaacaagcttcttttcatcggaaggaaccatctgaagggctgtatccggagccagtgccgccagttcctttaacgcctccacctcgtcaggcgtaagacttaccgacctggaaataatggtgcgctccgttccgtcgccgctggtaaaccgtcctgcattgccgatattcacatactcgataccaggtacggctttatacacctccaacgcattcttcaccgtcttaaccagtaccagaatccgcattccctcagaccttggattatttaacagtgcaatgatttccggcacagtcttaatgatacatttaatgccatccggcacagccattttcagtgtcattttctgcatttcattggaagcagcctcatcgtccgcaaccatgattccctggattcccaaatccctggtccacgccatggccacctgtccgtgaatcagtctctcgtctacccttaaagccttaaccatactatattctcctctccttatgagcacttaatgcctgtatttccgacgccttcgtgcgatacatgcagcttacttcctacgcaaagaaatcctcatcccggctgtcatccgcttccagctccaccagttccatctgtttttttgaatcctcaatgtactgccggacatcctccctggtaattccttggggcgcaatggccagagccaccagcagaggcaggttgaagccggcaatcaaaaacacattttcccgcaccgcgtagggtacgattttctggttcacactcccccccttgatatccgtgagcacaattacctggtcctccggctgaacccgggcaaaatactgttccagtgtctccgccaaattttcatcctggtccacataagcattgatacaggtaatattcccaacatctcccataaggaatttaaccgtactctccgctccggaagcaaaggttccgtgtgtggctattaatatcttcttcatgttggaactccttccctttttctgttttattttcatttcacttatatattcagcaaatacggtgccaactttttttagacacttggcatccaccccaaaacccttgattttaaaggaataaatttattcagctatcgttctatcaaaattttaccacaccttcccataaagtgtctaatattgtgtctaacattgcgtccaatattgcgtccaatattgcgtccaatcaaaacaggagtaccgccctcacttacgaatgagagcagcactcctgcttatttttagttcttctttttaagttttaaacaagctctaaagctgttcctcagcaataaacgcctcaaaaggctgtaacatgccgtttttcataatctccggctcattctgaatgattgccttgtaacccggatacagaattccctcaagacggctgcccggtaccggaacgtctgtcagattggctgccaccagccactttttccctttatattcccgctggtacacaaacagcgaatcatcctcaggcagcagcaggcggtaacttccctctgtaagaatatcctcttcgtggcggaggcgaatcagcttctgatagtaatggaacacagagtcacggtccttaagagcctcctccacattgatttccttataacgcggattcaccttaaaccatggagtgccgcaggtaaatcccgcgttctccccatctgtccactgcatcggcgtcctggcattatcccggctcttgttccagaccgcccgtttaaatgcctcccggctgatggtcttttcgtgttctaccagctctaagagggcattcttcacttccacatcctcatactcatccagctcataggaggcattcaccatgccaatctcctccccctggtacacgtagggtgtccccttcataccgtgcaggatcgtggcatacgctttggcgcattcctttctgaaacaggtgtcattgccccagcgggaaatcactctgggctggtcgtggttttccagataaagcgcgttccatccatggccctccagcttttcctgccagtctgacataacccgtttcaaatccctgacatcaaatggcttcaatgcccacttacggttcacatggcccggaatgcggtcaatgttcatgtgttcaaacgtaaatatcatattcaattcccgccgctttggatccacaaacagccgggcattttcagaggtggagccaggagcttcccccacggtcatgcagtcatattccgccagagcctcccggttcatttcctggaggaattcatgaagccttggaccgttggaatgcataaaaccggtatagtaacgcctgccgggttcttccggatagtccggaaaatccgtatacttggaaatggaagcaatcacgtccatgcgccagccatccacgcccttgtccatccagaatttcataaggtcatagacctctctgcgcacggtctcattttcccagttcaaatcaggctgcttcttatcataaaaatgcaggtaatactgctcccgttcctggtcataggtccaggcactgccgcagaagctggatccccagttattaggctcgctcccgtcgtctttcgggtctttccagatataataattgctgtaaggattgtccgccgatttccggctctccgcaaaccactggtgctcatccgaagtatggtttgcgactaaatccatgactatcttgattccacggtcatgggccttttctatcagctcctccatatcctccatggtaccaaatttctcatacatctgccggtaatctctgatatcgtacccgttgtcctgctgcggggaatcatagacagggctcagccagatgacgtcaattcccaggttttccagataatccagcttccggataatcccctgcaaatccccgaacccgtccccattggaatccataaagcttctcggataaatctgatatacaacggacttcttccaccaatcgctcatacacacatctcctcatgatttaaaattcagggaaagccgcgcaaccggctttcatccatgtcatgatgcgattatatacaaataccccgttcagggtcaacaggttacggccataacctccttattgcacaacccctgatatcacacgtcatacacaaaatgcggaaccggacggccgtccacaggggaccgtgtttccccgtcccggaccgcgcccatttttctgtaaaatcccacggcctgagggctggtaacaaaatgaatacggcatatttcctttttttcgcaccagccggtcatatgctcccacatctgttttcccagtcccctccccagcctttcctctgccacataaaaatactctaattcccatgcatctctatcctgcctgattccccagaaggcagccggacagccgcgttctcctgccgcatacacaggattgcggcggataaaatcttccgtaacattaaaccctgcgtcaaagtgttccataaacgcctcatcatatccccagtgtgcctccgaagcccttgcaagccggcgcagcgcctccgtatcttcgggctcagccctgacaaaccccagagcctgccttttataccggccgggataaaggctctttgcctccctggtaaatctttccaccacagctgttttctgctctgtatacccatcccggtcatgttcatattccttccagagtcccagcttcagctcctcatattccctggctgcttccggatgctccctcagataatccctgaaatacagctcgtcgttatcccccgcctctctcagatgcagatggaataccttctccgcaaatcccgacggcgtataacccctgttgaacgaaatcctccctggcttttccatcatgcagatgtagccgccgccgataatatgttccttcacggcctgcatatccccgccttccctcatttccaccaggatatccactatgggcttggcccagatggatgggatggatgtgcttcccacatgactgatttcgcagatatcctccatgggaaggataccaaacagcctctccctttcctcctggtaccactgcgcccagaccggcctgtgctctgtgaggaaaacagggaacagctgccacagttcctccaggctcatgccggaaaacgggtcctgtctatccttcatcatcatatctctccaattttttctcccattcctcctttacccctttcatcctgcggaaataagagctcatctcatccgccatgcctgaaagacggtttaggagcgtggagaaatcctttaacatttcatcgtcctggaaataggggtatacgatatcatggtcaatctcactccagccctcctcgaacagggttcttccctggatctccacataatatcccttatatttgatgatatagtggagggagcggtatataccgttggacttaatctcaatcaaattctcgtcataaatcctggtgtccccgtttctgcggtagacctttggccgttccgcgatgtaataatgcccggtgtcctcatcaaaatcctttatgcggtccaccacatatagatcagggttattctcaaatacactggttatatatttgtggaaatgaatccaatcctcccggtaaagaaaaaacacacgaatgccaatcaggtccgtgatatacttatggtaattgcccctgtttatatcctcaaaccgttcaaaatgttcgttgcgcttgcgtatgattttctctatcagatggccgggatccttagtgcggtaccggtaggaatggatgcctgccctctcaatatcatagagataatcgtacacaaaatccttaccaatgctgcgcagttttccctcaatggacaaatagtcatcatagatggccgccagctcctcccattccagaccggccgccttaagttcctcaggttcaatgttgtagcttgttagaaaattttccttgtcaatcatccggtatcattcctcctgtgtgtctaaaatgtctgcatatccttacagccgccgtacgtcatccgtcaatggggcttcatcaccaatgccctttcatccactgcccgcagggttgccagtattccgtccaggtgatcgtactcatgctgaatcagttccgacatatccccttccagttccatggagcagtcattccattccagatctttataatatatgatgcaccgtttataccgctttaccctgaccagcagatcaggaaatgacatacaatcatccagcacgtctatcatctcctgttcaggaaaggcaagccggggattgataaacagcaccggagtgtccagatgccggtaaataacacgtttcttcacaccaatctgaggcgccgcaatggcccttcccactccatagcgggccctaaatgccaacagtgtatcctttaaatcctccctcacctgttccatctgatgaagctcttctattttcacttccctgctgacctcatataattcaggatttcccaataacagaatcgtccgctccacgtcaaaacctccctctgcgctgttttcattcccgtacaacgcgttttcctaagtatatcatgattccatccgatttccaaatcccaattaaagggtacggaaaaaaatccggactgcctcttaagtcgagacagtccgggcctgtatgcctttatgtatattacgcctgggggaactcaatcagattcagtccgatggtttcactcatccttctgccagcggttccgtcaatcaccgtaataaaaatctctgcggtggcgctgataaccgccctgttcaaatggcctccatggcactctccatccagcgggttgccgattaccatgtgcagatgaagatatgggttttctccctgctgtgttatgttgcctgtaagggaggcaatttcatagattcccttgaaggactttccataatacttcttctgcgttgtatcaaataccccaagttccacctcacaggcagctcccagcccggaaacctctcccagagccaccttttctgttctgcacacttcccggatacactctgtcacttcctcgcccggattcaggcggaggataattttttgtccaaatctcttatattccatggtgttgactcctttcaaacacagtttacaatacatttaaccattatatattcatgtatgtaagatgtaaaattatattttctacggtctgctctaatttttcgttatgattggctgtgtctgagttttaaaaatatgccttggaattctcccgcatcaaaaatcacatcccggtccgaccctcccattgtcaaattccctatacaggtatataattatactaatatctttttttaaccatacaaccataaagataccagggaggtgatacagaatggataacgcaatgaaaatacctgattgtcccgtggaaatgaccctgcagcttatcggcgataaatggaaggttctcatcatccgggatttgctcacaggtacaaaacggttcaacgagctcatgcggtcagtaaacggcataacccagaaagtcctgaccagccatctcagagccatggagcaggcaggcctgattacccgcaaaatatatccccaggttcccccgaaggtggaatataccctgaccgaaacaggatacagcctgaaacccatactggactccatggtagcctggggaacagattacaaaaagaacataggacaaatgtaaacgcacaaagagccgtgtccccggtttctctcaaatccggggagcatggctcttatgtgatccttatatgatctttatgtgagctttatgtgaactttatgtgaactttatgtgatccttatatgctccttatgtgaaatcactatgatattatccctgtgcagccggctccagtcctaaaaaaaccgctgtgtcctgaagcgccttcataccgtcaagacgccctaaatcatacatttgctgtatcttctccggtctgttttctgtccggctgattttaataagacggctgggacgtatgacaaagatttccccggcagactccatgcgtctgacctcctccagttcccggttatacatcagatggcggcactccatggtttttataaattcgggatatctgcggtataccctgcggatagcggggagcatttggtttggctttttgcggtaaccatccggccgggtaagtatgaccaggcttcttttaaagcccattttgcggaatgcagctacgggaatggagtcggatacgcctccgtccagcagcttctgtccgtctatctccacaatcctggataccagaggcatggaggcggatgccctgatccattgtatgttctcccctctcaggctgccgcatctgtgatacaccggcctgccggtttccacatctgtgcaggtggcataaaactccatgagcgaagcctcaaaggcgtcattgtcaaatgggtccagccgctccggcagttcgtgataacagaactcatttcccaccagatcgccggtcattaccagcgaccggaaactcatataccgcgggtcgcggcagtacttcagattatagcgtatggagcgcccggcctgtcccgccacaaagctgcatccatggatggctcctgccgaaactcctaccagaccgtctgccttaatcccatgttccaataatacgtccaatacgccggcggcgtaaatgccccgcattccgccgccttccacaacaattccagttttcatttccatctacctctttacaggcgtattttaggaattagttcttacctcatcccactggccatggcctgtgagccagttcagagccttgtgccattcccttaccaccccggtcttcatgcccacaggctccggcagttcatggcgtctggcattgatgcaggaccattccagacaggaaataaggtcgcaggcatccaacagctctctggggctcttaggtctggactttgccatgattttactgatactggtgccatttctcagtagctttaccaaatcagcgggattgcagggatgatccgggaatcccagctcctccaccagtcccagcgcccattctaccacgtgaagggattcatactgccttaagaaatacaggatttccttcctgtcgggagccgtatcgtgcagatacttccattcctttggagagaaataatcctgggtattgttattatcaatataatccatcaggaaattctgtgccttttccatcccctgtttttcatccagaaggcattccgaataaatggcaacgcccataatggccagggccctctgagcagtctcctccagggaggggcaggttatctgtgaagcaggcgcaactgcgggcagccatcctggtacatagattgcatttccgataagcgtctgcatggtgcgcatcctgcggtccacctgctcctgggtgatatcctttccggcctttaagtccggctcctgatagggaagatagcgggtaaaggcgcttccgcccttgtcggacagaatcaggagcttttccccattttccccgctgcagaacatgccgtcctctttctcatcctggttctgaatcaggataattccctccagatcgtttaaaatggacacgaacatatcctcaatcatggtcttcttgtcctcaatatcctcttcgtcctccacgtcaaaggcatattccaccagcacaaaacttctggcccgtccaatctggtacagcaggttggtcttaacatccacaacacctgttttaacctgataaaaatggtcgcaggttccctccacctgtctctttataaactcctccgccttttcaccggcagactcgctggccactgccagacggatttctatatctccgttatgcagaacaagggtatcccccattccctccgggtccaggccaaaggttgtacacaaaacctgaatgattttttcctgtgacgggatatctgagaaaatgaaggacttgccttcatatcgctttgctggggctgatgtcatattctctgccattacaggctccgtattctgattcttatcattttcaaatggttccatataattctccttaattctttcgttgtctgcaacattttgattatactatgtttggcggaaaaacacaaattaatccttcaatatatataatttatgggcggacagccggaaacaatatctatttccggctgtccgcccataaatacctgttttctatttcacaccggaaatttccggactcccttccattatatttctcatccactcttttatcattcgtttgtcaatcttgccattatgggttttgggaatatcctccacaaagacaatatactccggtatcttaaaacgagccactctggtcttaagcatctcctttatatcttcagcctggacattcgttcccttttccagtttgattaccgcagccggtacttccatatacttggaatcaggtacccctacgaccacggcctccaccacgcccggaagggtgtggatggtgttttcaatatcaaaactgcacaccttttccccgccgcggttaatcatatccttctttctatccacgatatacagataacccgcctggttatagtaacccaaatctccagttctcagccatccatcttctgtaatagagtcagccttctgtttgtagtattcctccactacaaaactcccttttaaacatatctccccgatttgattttccatcaactccgttccatcatcatctgcaatcttgatccgcaggtccggcataggaatgccggaagccccaatccacgggctgtccgccgcgccgcccggaaatatggttcctgctccggaagtttccgtcattccatatacagtatggaactcagcctgcggcatccattctttcagtttccgtatgttctcaggagccatatttccgcttccgcacgcaaaagacttcacagaaggaattaacggatagctgctcctcttttccagcagtattgtaaacacggtaggagacgcgtgatagaatgtaatattattttcaagaaaacaagtcaatatccggtccgcatccacctttttcatgagatagaccgtacctcccaccgccagcataacagacaaaatacatatcattcctgtcacatggtacatcggggtagctattacagaactgtcaagctgggtcagccttaaggttgcggcgtatgcttctactgaattcatgacctgataatttttcatggcaacgcctttgcttctggatgtagtgcctgaagtaaacatgagaatagctgaatcatcccacgttcccacaccatccgttatttcgttatcctccaaatcacggagcatccagtccaatccaaaatccggtccacttttcgatacaataacagttacgtgctctaaattttcaaaccaaggctcaaacttttcttcacagattatagttgtaacatctgctttctccaacaaagacaggatttccggcctctgaaactttcccgggagaggaaccgccaccccgccaattttattggcggccagatatgacacacaaaattccggcccgttatacaggagaattccaattcgctcccctttttgtatgcctgtttttttcttaagcgacgcagccatcctgtctgtcatatccagcagccggccataggtcaatgcttgtcctttgtcatccaccactgctgttttacctggccatctggcagcggtaaggccaaaggcatgatatatgctgtctgccatgccttcatacacatggatgttccggccgcctgccccggcttcttttatacgttcacgcagcaggtccggccaataattttcccaagataacatttccttttcccctcatacggaaaggcaggacagactattctgaatgttcgatatctaacagggctcttctggaacgttccaaatggacctgcataatatgacaggcaaaatccccatcgccgtcttccactgcaccgaataactgacggtggtccatcatggaccgggatacgattttcggatctctgttcaggcggtccgtgtatctctgagcaatatcattgaacatctgggatataaggacgagaatccggttcttagacgctgaaaccagcagatcatgaaacttcctgtcgtatttcgaataggaagcaaactcattaaaggcaatggcctcttccatattgtcgagataacgcttaagtaccttaatctcctcctccgttctgtttttagccgccagtctgcatgccccgctctccacaaacagtctggcattatagatttcatcgatatcattttccgtcactgtcagcaggttaaacagaggcttcataaattcagaaggattcacttcgtttacatatgtaccatcaccctgcatgattttaacgattccaagaacattcagttttttcaggccttccctgaggcagacccggctcacacaaaattccaaagccagctccgcttcaggaggaagtctgtctcccaccttccatctgcccttccttatttcttctaaaatttgatccgcaacaatatcgtacttatattttttctttccctctcccattgccatcctccccccctgccagctcgttttaccaaattataacatcagctgttttaaaccgcaagtttccccgccgacatcaggagtatcgcacttgattatgtaagcatctgcggaaggaaaaggcttatggccggaatatacgtggtcaaggccagaaccaccagcatgtataccagtagctgcaatgcgaatttcaaggtactctccaactgtattttactgattttacatcctacgaacaaattgattcctaccggcggcgtaatcataccaatggacagattcattacaatgataacacccagctgaatcggatccacgcccaggggctggacaattttcagcagaatagggctgaggataatggtagcaggagccgcgtccatgatcatgcccactacaaggagcaggacgttaatcaatataaggataagatacttatttgtagtcatatccagaacaccgttcgctatggacgaggtcactccttccagggtgagcagctttgcaaatgccgtggaaaaagagataataacaataaaactgcagctcttggcagcccgcataaagactcccggaagattcgtaagcttcaggtccttataaatgaacatacctgcaaaaagtgcatacacacaggccacaaccgaagcctcggtaggagaaaaaacaccggaataaataccgcccagaataatgattggcaccagcagagcccagatagcttccttaaaattataccagaaccccatgtcataaactttttgcagttctgcctttacctctggtcccggaacatatttttcctttaccgatatcttctttgcaatgataatcattgctatacccagaaggattcccggaaaggctcctgccagaaacagctttgcaaccgatgtgtttgtcgccactccatacagcaaaaacagaatactgggagggataataggccctaatgcccctccggctgctgcggccgccgtggaaaactccttactgtatccggcacgaatcatctgcggaatcatgatgcctccaatgcaggcaactgtggcaggacctgagcctgatatggcagcaaagaacatgctggcaataattgttacaattgcaagtcctcctggtctgtctttcaccaggctcatacagaaattaatcagcctctgggatattcctccctcaatcatcagttcccccgagagaatgaaaaacgggatagccagaagggtaaagctgttggttccattgaggaaggactccacaatcagcgacatatctatggtgccaaacagattcgaatacaggcagcataccagccccaatgcgatggctatgggaaatcccataaataccagcacgaacaaaccgccaattaatattgtaccagccatctattctccctccctgccactgataaattcataacgtatgataaagtaaatattcataaggcaccggatagcggatgctcccattcccacaaaaagcgatgccgacataatccacagcggaaactgggtaatggatacggtcttcatctgaaactggtcaattaccctcaaaaaaacataatatcccacaaccgtgacaaaaaggaagtcaacaacatataggaacaaatgggcagcctcttttacttttcccggaagcttgtcaatgacagccactatctgaatatggtcatttctgaggaaggccccgctgcatgccaggaatacaaagtacataaacatatagagtgaatattctgaaatccatgcagcggatgccttaaatatatatctcatgactacctgtacaaaaagcatcactaccatgaccgccagaagaacagcgcccacccattcttccaggtgattataaaatttattctcgttataataagccttcatatgctcctcctgaatcaaaaatcagttactgagcttcatcggtgcggccaaggatctccagaacctttttcacattttcctttgatgtaagagagacgttctcatcccaccacactttgtccacggaaatctgtctcagcatgtcctcgtcttccttggatgcttcggtcacaattacattcttttccctcatttttccgattgcttcttccagataatccacttccagttcccttgtcctggcgatcagcttatccacatttttatctataatgggtttcaaatcatccggaagcgaattgtaaaacttatcatttataatataaaaatggtaactctctccgcaatgtgtggtcagtatactctttaactggtcataaaagccattggaataaaacaacggcacattggtcaccataccatccacggtaccctgggctaatgctgtatacacctctgaaaatgcaatgaactgggggttgatcccggcgccttcagacagggcaatcatctggtttgtctgattgattcggattgccattccctttaagtcggcaatctgatgtatttccttaccagtggctgaaaaaccaaaccatcccatatttactccgccgtcaaatacctttacgcccgttgcttttgtaaagtctttattcaatcccataaaccactcgctctcggcaaccgcgttcagttcctcatccgtggacatcagatatggaattccatatacataatactcagacattccggaaaggtcggcaaaacaattgggtgtggtgttgcccatctgaagggtattggagcgtaccttgtccagcacgtcggcatccgtctcgccaatggaaccgctggtaaacagctctacctgtatacggccttcagaagccttttccacctcttcctcaaactcccggtacgcaacattaaatggatcgatatcagaaaccgtattgcctatcttcagtgtaaacgtctcaccggatgccggttttgccgtctgttcagcactgcccgcgtctttttttccgcatcccgccaatagtaatacagccaccattaccaagaaaccatatcttctcatcatagttttttcctccaattcatttctttaacttctgtacaaattccaccaggattccttctccaaatctgggacggaggaagtttacgataattcctcccgcccccggtacagctgattcttccagaagtttcatcccctctgcttcatacttccttttgacctcttccacgtcctccacttcaaaggcaatgtgatgcatccccccttttccattattatatgtagccaggaccccctccaaaggtatcaccagttcaatgggcgtctcatcctccttatgctttgtaaaaaggcagttggatttgtaagactccacatattccatataatctgtttccagaccaaattttttcataaaccggtctgctctttcctgggaattcatgactattcccacatgatgaagtttcatatgttccataaccagcacctgtcatccttttatgatattctttaaaccaaatggaccctctctgtatatgtgtatcggagtttctttaatatgttcggcaatcagcgggcgaaactccatattggccagtatatcccgttccagatccgcccctctggcaatttcaatcagcatgggaccatcctctgtcagctggaacacagcccgctccgtgacataaaacatattctgtcctctggaaaccgccattttcccgttataggatatctgctgaaccttctttaccagtttcctgaaccggccttcctggagtatttttattccacattcatcaaattccaccttgatttggccgcctgtaaaggtagaacagaataccacgttctttgcagtgctggtaatatcaataaaaccaccggcgccggccgcaacagaccccattttggttgcattcacattcccctgcgcgtccatttcccctgcgcccatgaatgtataatcaattcctgcccctgtataatattcaaactgccggtcatggggtatcagcgcctggggactgcacgaaatgccaaagtcaatccccccggccggtacgcccccatatatgccggactcaaccgtcagcatcacatcgtcctgaacatcttcctccgccagtataggacctatgacatcattggggataccagtacccacatttatgatgacatcgcttttaagaagcatggcagcgcggcggcctatgacttttcttatgttgagcggaatagaggatgacgctctgagcggagtatgaatctgaccgctgtaggaagggtcaaaataccaggatgatgtctgtttatgctcctccatgggattttcgcaaaccaccaccgcatctaccataacccccggtacagccacccgttttggatccagggtgccggtccgtacaacctgcttcacctggcagattacctttcctccaaaccgtttggctgccatgacagcaggaagaacctccagaaccattgcctcttcttccgtactgatattccctgcttcatctgcgtaggtcccccgtatgaccagtgtgtcaatgggcacctcacggtactgcatatattcttccccatccacagttaccaccgccactatatcttccttgtccatggtcctggaattcatcttccccccttcaatccggggatccacaaaggtgcccagtccgattttacttaattttccaggttcgcgcagtgccatgctgtggaacatgttggccatctgcccctgcggaaggttgtatgcctccaaacggttttctgaaatcatttccatgaaaggaggacaaagaccccaatgccctcctatgactttcgttaccagtccttcatgggccagatgggctattccgtcctttctgtcagactggccgcaggtatggaataatgtaaggccgcgcggcgtacctgtgtccaggaatttctgttcaattgccttcagcacagtttcactggcagataccaatgtcatcccaatggtacataatgtggaataatcctgaatcattccaaccgcttcctgtgccgaaacaaatataggttttctcataatgttctccattctctgtgctatttgcgtcagcacacctttatctgtttatttccctgcccttaagagcagagttcaaataacacggcaaggccctggcctcctccaatgcataacgtggatactccgtatcttaccttccggcgaatcatctcgttaatcagcttaatggtaatgatgcatcctgtagctccgatgggatgaccaagggaaatcccgcttccgtttacattgacaatattctcatccagttccaattccttcatgcaggccactgcctgtgcggcaaatgcctcattcagttcaatgagtcctatttcttcttttctaatccctgtcttcttcagcaattttctgaatgccggcacgggtccaattcccatgatggacggatccactcctgccgctgccacatccacaaggcggactaaaggttttaatcccaaagcgtttgctttggattccttcataagcaccacggcggcggccgcatcgttgattcccgctgcattacccgctgttacgcttccgtcatccttaaaagccggacgcaattttgccaggctttccgctgttgttcccggacgcacatgctcatctttatcaaaaatcatggtttctttcttactcacctttacttcgataggtacaatttcactgtcaaatttcccttcctcctgagccttgcttgcgcgctgctggctgatagccgcccatcggtcctgttcctgtctggtcacattatactgattggcaacattctcagctgtaatacccatgtggctgcgcgtaaaaggatcagacagagccgtaatcagtccatcctccagctctccatgtcccatacggtacccgtaccgggcctttctcaaataaaaaggaatattcgtcatactttcacatccgcctgccacagcaatctcacacataccactttcgatttcctgagcagctgtgacgatagcctgtagtccagatgaacatagccggttgacggtaagtgcggtagcttcatacggaattcccgcttttaccgatgccagccttgcagcaaatgcgttctcggccgcctgccccacacacccatacactacctcttcaatatcttccggcttaaggccagaccgcttaacggcttccttaatcacgatacctccaagatccgttgcttccagatcctttaacgctcctccaaatttacccaccgcagttctgcaaccggatacaatcacaatacgttcgctcattttttcctcccttacagtaccattccgccgcccacttcaaatacaccctgtgtaatatacgacgcctcatctgatgccaaaaacgcaatcatatttcctatatcttccggtgtaccggcacggcccatggaaatttttccaaccataatctcccaagctttctccggcactcctcttgtcatctccgtatcgataaatcccggtacaatggcattgcatgtaatatttttctttccattttcttttgcgcaggtcttagtcagagctaccactcccgccttggctgccgcatagtttgcctggccgatgttgccgttaaggtaggatgctgaggatatgttgataatgcgtccatactccctttccctcatgtaattaacggctgctctcatacaattaaatactcctgtcaggttcactgcaatcacagcattccaatcatccacagacatcttgtgaagcatcctgtctttattgattcctgcattattcaccaatatatcaaggcttcccatttctttgattgtggcgtcaaccagattctgcgcatcctcatatttagaaacatcagccagtatatagatagcctttccacccattgcctctatctcagccacgccattcctggcattgtcctcattcacatcagatatcactaccgaagcccctttctcagaaagcttcttcgcaattcccaaaccaatgccacgcccggatccggttacgattgccactcttccttgtaaatctctgcccataattttatcctttctccaaacaaacatcttattaataattccaaaaggtattatttttgcatccggatacattgctgtctcttagaattattatagtaaaataatactatttctgaccttatatgtcaataattttgggcatgttttactattttcagtgtggttatccagtatttcatggttatttttatgcatatcttatatttttatttacaaaacataatatgtttaaatacaattaattggaaatagtaatatgttaattaatagtttaacgaactcttcccatcgcgctcccaaaaacgtatcctgttagtactgcaaaaaaacagccaggcacactatctgtacccggctgtccatacataaccctctatttcctgttttccttatttattttcccaacgttgtttcccttcaaaataatccgaagccaccatcccatagatacactcatcgcatatcccctgattattccacccataccggcggagggtgccctccttcttaagcccgcaggccgccataacctttccgctgttcacattgcgtatatcgtgcagggcctccacgcggttggcaccctccacctcgaaaaagaaccgaatcagttccgcaaatgcctccttcatgattttgtggccccaccaattcctgcccaggcagtatcccaccgtcacacggcccgccttctggtcaagctgcgggacagaaatgcttccaatgacattgccctcgtcttccttccgcgcgatggcccaggtgtaaaaatccttagactcgtatgacttaatccatccctccagaatttgctttgtctcctccacatccttgtgaggttcccaggtgaggtacttcgtgacctggggatcgtttgcccagtttctaaacatggcgtcggcgtcctctatcacataagggcgcagcaccagccgctttgtctccattcttacggttccggaattcttcataaggttcctctcctttcctgcacatacaaaggatgtgcgcagcatgattgactggcagcaaaatattattctctaatatagcacacatcccgcattttaggaacccttgatattctaaattatttgatatagccatgctctctgccgcttgttccatccaccgcttactccatccaccgctcgctccacccaccgattactccatccaccgcttactccatcccgaaatacacctttaacgctttccccataaactccgatgcaccttccccgtatttcctgtctgttatttcctgaaacgcgggattcgtcatataattattgaccatgaaggaccagtagctgctgcccatatccattcctccattgctttcattgataagtgataccagttcaccggctatcttctgtacttcgtccgaaccggcttccttactcaaatccgcggtaagcttctttgtcagcgtatccgttttatccacggcctcatctacctctttctgtgtgaacccaggtccattttccagaaaatgctgcagattttcctccatggcctttgtgaatttctcaatgctgccatattgttttactgccatctgtgctatgtgaccttcgttggcctttaactcagaaatcatttcgtcaaagctctccatactgccaagctgctttatgatttcttccatatgtgtccttttataatctgttagaacctgaaaataattgctcatatcaaattccctgaaatccaaagttctctctccttttataagtctgtccaacagctccagcagcgcgtttaacctgtccctcttaatctgaatcagttcccgctgtttttcaaatgcatccttcctgtcatacaaagggcttgccataatagcctttatttcctttaatgtgaaatccagctccttaaaaaacagtatctgctgcagcactgccaatgtattttcatcatacatcctgtatcctgcttcggtcacctgagtgggcttaagcagaccaatttcatcataaaactgcaatgtcctaacgctgacaccagttagggaagacatctgtttcactgtcatcataccaatcatccttctttcattttcagagcttccgcctatgattatctgccggcagcggaatatccgcatcagctttatctcttaccactactgtacactatcacgttacgtaagagtcaatactttttaaataaaaaattcttacatgcaaaaaggagcttccccaaagcattgtccccgacataacgcatgtccggtcctgattctgcctcccgaaaccccctttccagcagtaactggcatttcgttgtatgcatccctctgctgccgctgattttccacagccgcctttatgcaagttcctccatcagctcttcctgcagctcctggttcaccagtttcatgtcaccctcaaacaccttgggatatggaaatgccatgtccccgtataacttgccgaatgccacgtagaccttcttccccttcagcgcaaatatagtccctatgccatagcgcttgtgctccaccttttgattcataattctcatgttatccgactcctttctttaaaacctttcttttaacctttcttccggccgtactttcagcctttcttccgtccttactttcttccttactttcgtccttatttctaatcctcttctaaataacctttgccatcttttcccttgccagccgttccctagccgctttccttcttttctttaacaattccgtctgctcctgtttcctttttgtctcatataactgataaaccacaagacgctgttttgcttcttccgttcgcttcttctttaattccatgaccgcggcttctgcccgcttctgaaggattggatcgtcaaaacacagaaaccgctcaaaggcatcgggatatggaaatacctttctcccggcttcaccatcaaacagaaccaccatatggttctgtaccacctccgccactcttccagtcccatacctgacatgtttcacggattcatttttcatcttctcaccttcctgcaaaagcgttgactgttccctgctcatcatccattgagctgcttcatccggattcttccggattatctctgtcattattttaccattttcccaaaacaaatttcaaaggagaactttctcctcaaaaaaactttgtgagttctgtgcagagggaacctctctgtttttgtatacttttcccgcgtaccatcagcctgtttctgcaagcagaattaacccgttacgcaaaaaatgccctccggctgcatgatatgccggaaagcattttccataaaacttattttcaagtccaatctttattccatccctgcaaaaaatcactccactcccgcttttttgcaaatatcattgagacagcatgcctcacagcggggttttgtcctggctgtacagacgtcccgtccatggaataccaatctgtggcagaaatcgctgccctcctcaggcggcacaagcttccacagtgccatttccaccttctttggctccttaattccgtccaccaggcccatacggttcaccaggcggatacagtgtgtgtccgtcacaatggcaggctttccgaacacatcccccataatcaggtttgcgctctttcttcccactccgggaagctttaacagggcgtcaaagtcatcgggcaccttgcctccatactgttccttcagtatcttcatgcaggcgcttatgtccctggccttgctgtgtcccaggccgcagggcttcactatccgctcaatatcttccacatccgcctctgccagggcatccacatccggatatttggcgtaaaggtcctcaaccaccacgttcactcttgcgtctgtacactgtgccgccaggcgcacactgaccagcagcttccaggcatggtcatagtccagggtacagcctgcatcgggatattcttttttcaggcggtctatgatttccaatgcaagtttttcctttgtcatgtcgtatctcctttgtcattggttttttattaaaaatgttagagttccaaaaaggatgaagccgctgataagcttcatccgtttctgtctcaatcaaccttttattctaattctaaaagcctttttgtcgtaatctcgagcataaattcttcgaccgtctttggtcgttgtccatgtacgaaatatatacatagtctctccccctttcgcaacatgcttgaaaagaggatatctttgtgttatacttagtttgttaggactgttagtataatcagctacacaagattatcctttcagcatatgccagatattcctatgtatctggcattttttatgtaaaaacagcaaaagctgcttatacaccatatttgccttaatctactatcttactatatagtaattacgacctccccttatcattttgcagtattatgtcatccaaccgttttttgccttctgcaatcgttcgaagtatctgtatactttcagataattcaggtgttatactccatggatcaatgggatatggattatctatcatatcatagtacctttcatctatatttagaaatgataccatctgcttaacaaagctcaatgcactttccattttttcatcttttccttttaatacaggattccattctaaactttgttctatgtttctaattgacgttctttctagctctggagatttatgcttaacatcctctatttctacttcccctgatcgtgacaacgcggtaaacgaatgtaacttttccatttcatctttgtaattatccgtatattccgtcgtcttttctacaatccatctgtaggagccacgcttaccataaggctctaaacaaccagactttttcagcttattaatgatggtataaaacgtgttttcattgaatgtctctcccattctttcatcgacatactgcttcatttccttaacattggattcaattttgtcgttaaaaaaagtctccagaagttttctgacgcattctatttttgtcacggtatcacctcatttcctttttatccaattcttctcttttattctatcatgtattctttcatttttcaatagtcttttttatttttccattaccattcacttttttggttactgttcagccccccatttagttattgtataaaatgctatttttaaatattttattttttgctggatttagaatagagaaaggaaacggcaccgtcgtttcctttctctattctttagccggtacttatccacacatatgagctgtttgaagctgactattgccgataaagcttctgctttaggacgtgttttcaacggcattgctatctttttccacaatcaaaatgccagtataggcaaaccattggattcgctttttccggcagttttatgatagctttccataatatcttgaataccggcttaaagcagccagtgcagaagcagcggcttttaagtctggcaaaaaatatctggacatgcaggaaaaacacgaaaaaacggtccgctcctttgagcgcaggattaagaaacaggataaagaactcgccgggtcccgccgtgagataatcacggtccggaaccaatggtttgaggtgttcgggaatctggaaaaggaattcaaccaaaaacggtcggcagctttaaaagaaatggaacaatttaaaaaacggctgttcaaaacgcagggccagctggatgaggccctggataaagtaaaggaacagcgtctggaggaaaaggcaggaacctccagttaagggcccagatgaaccgtgattatgaaaattcctctctgccctcctccttgtctgtaaaacacaaaaaaatccaaaacagcagagaaaaaacaggcaggaaacccggacatgccggacacagccgcaaaaaacaggtccccaccacggctcccgtccttttaccgccgccacaggaagctgtggaggaccctgatttcaaaaaaccatcaaaatcgattgtaaagcagctggaagtaacagaatatcaggctgacgtttactacaactcaaaaacaggggaaaggatccatgccgaattcccttgcgggattgtggatgatgtcaattacggtgggagcgtgaaagcctttttgtttttgctcaaccatgactgctgtacctcgattgataaaagcagtaagtttctgtcagatttaacggaaggaaaaccgaatctatcgaaaggcatggtgatcaggctcagccgggagtttgcctgtaaaacagagcaggaacgcagaaagatattttcggacctgctgctgtcacccgtgatgcatacagactgtaccaacgcaaaggtgaacggagcaagcgcctatgtatttatatgcgcgtcccctgacgggaaggccctgtattttgcacgtaaaaaaaggggcacgaaggtgtaaagggaacgccggtggagacataccagggaattctggttcatgaccatgagtcgacctttttcaattatggaacggaccatcaggactgtcttgcccatatccagcgccagctcaaggacagcattgaaaatgaaccggaccgtacgtggaacaaacaaatgtattccccgatccggggaatgatccattaccggaacagcctggaaccagggaagggctgcgataaggaggaaatgacaaaatatgaagcgcgctacgaccagatcatggtgaaggcaaaggaggcgtacgaatacataccagccaccgagtattataaggaaggatataatctttcgagccgaatggagaaatacagagaaaaccatctcctgttccttcataatctccaggtgccagctaccaacaacgaagccgaaaggctgttgagagggtacaaacgaaaacagaagcaggccgtgacattccggagtttcgagagtatcgattatctctgccaatacatgagcatactggttatgatgcgccaaaaggaatacgtgaatttatttgacagagtatcccagatatttggataaagaaaaatcgatggttgtaactgaattcagtctacaccatcggttcattcatttcaagttgacgtctgaacagtaacatttttttgaatccgttccatttctctgcacatttaaccactaacgtttatcttgtaaagcaaggattacaagcgaacaaaaatgccctcagccaaaaccaccggtctgagggacattttaaacaatacattatatatttagcttcacatacatcttatttaacaataaacgactttctcttactcaccacatcaaagataaccgctgccagcagaacgccgccctttaccaccttctgcaggttctggtccacgcccatgatgctcatgcccagattcagcacgcccataagggttgcgcccacgataaccccggggaccgtaccggtgccgccgtatgcggaagcgccgccgatgaagcacgcgccgatggcatccatctcatagctgtttccggccgtggggttggcggagttcagtctggctaccgtgaccatgcccgcgatggctgccagaaggcccatgtttaagtaggccaggaagtatacccggttggtattgataccggaaagcttggttgccttctcattgccgcccacagcatagaagtaacggcctgtggtggtcttggaggcaatatagctgtagattccgatgatgaccgctacccagataagagcgtttggaattcccttgtactgggccagacggaacatgaaggagagcaggacaacgcagatgactgccattttgatcacaactcccgtaagaggctccacataatatccctttgccagcttctgccgccttccattgaaaactataaaggcatagacaacacaggcaataactcccaccaggaagcaggtcaggttaaagccctccacagcaaagaaatccggcacataggtattgaacagcaccagaaactggtccggtatgggagccagcgtcattccctgaagcaccacgttggaaagtcccctgaacatcagcatgccggccagggtaacgataaacggaggaatcctgacataggcaatccagaatccctgccatgctcccactaacattcccatgatggccatggcgataagtgtaaggtaagggctgatgcccatttccaccatcatcttgcctccgatggcgcccacaaagcataccacagaaccaaccgacaggtcgatgttgcctccggtcaggatacagaacagcatgccggtggccaggataaatacataggcattctgggcaatcaggttgtttacgttctgaggaagaagcatcttgcctcccgtgttcacggtaaacagtatgacgataaccgcaagagcgataatcattgtatattttttcagaacctctgagattttcagcttttgatccatggtctactctcctttatcagctttaagaatacaggacataatatattcctgggtagcttccgaagcgtccacttccccggccagcctgccctcattcataatataaatgcggtctgacatgcccagcacctcgggcagctccgacgatatcatgatgacggacttcccttcctccaccagacggtttatgatacagtatatctcatactttgcgcctacgtcgattccccttgtgggctcatccagaatcagaacatccggctccgtaaacatccattttgccagaagcaccttctgctggttgccgccgcttagatttcctgcgttctgttccactccaggacattttgtcttcagcttatccttgtactccaccgccaccatgtattctttgtccttgtctatgactccatggctgctgaccgctcccatgttggcaagggtggtgtttacacgtatgggattggacaggataaggccgtttcccttcctgtcctcggtcacatatgcgatcttatggctgatggcgtcgtgcaccgtattcaggtggacttcttttccctcaataaaaagctgtcccgaaatattagtaccgtagctctttccgaaaatgctcatggccagctccgtacgccccgctcccataagcccgcagattcccaccacttcccctttgttcacatgaatggacacatggtccaccaccttcctgtctgagtacaggggatggtataccacccagtccctgacctccagggcagtattgccgatgttgatattctcccttctggggaaccggtctgtcagctcacgtcccaccattccctttatgatccggtcctctgagatgtcgtctgtctgtttatccagagtctctatggtggagccgtcacggatgaccgttatcttgtcagccacatatgcgatctcgttgagcttatgggaaataatgatggatgtcataccctcctgcttgaatttaagcagcagctccagcagggccttggaatcatcctcattgagggaagccgttggttcgtccagaattagcagccgggcctttttggcaagggccttggctatctccaccagctgctgctttcccactccgatatccttgatcaatgtatgggaggactcgttaaggcccactgtctttaaatagcggtcagcctcgtcgtatgtctggtcccagttaattgccattttctttcctttttcatttccaaggtacatgttctcgccaatggacatatacggaatcaatgccagctcctggtggatgatgacgattcccttttcctcactgtcgctgattttatcaaacttgcacacctgaccgtcgtaaatgatgtcgccctcatatgtgccgtagggatatatgccgctgagcacgttcatgagagtggatttaccggctccgttttcccccaccagcgcatggatttctcccttttccaccttcaggtttacattgtcaagggcttttactccggggaaggtcttggtgatatttctcatttccaaaagtatctctgccattctatccctcctacaaccatacaggcgggtgtttctccccgcctgtacgattctcatcttttccggcctgattggccggtccatctgattactttaactggtcttccgtgtaatagccggaatcaatcagcatttctttgtaattatcaattgtgacaacaaccggctcgcagagatatgtggggattacgcctgtgccgttatcataagacttggtatcattaacttctgcctctccgccctgcataacggcgtctaccatcttaactacctgtgaggccagggtacgtgtatccttgaatacggacatagcctgcttgcctgcaatcaggttctttacattggcaatatcacagtcctgaccggtgataatgggatattcgccggtataggaggatgcaagggcattctcaacacccagtgcagtagagtcgttggagcaaagcactgcgtttaaaacggttccgtcggagtaatttcctgcaatgatggtatccattctgttctgtgccttctctgaatcccagttagcggttgccacctgctcgaatgtggtctggccggactttacaaccagctttccgctgtcaatgtatggctgaagcacgtccatggctccgccgaagaagaagttgcagttattgtcagccgggtcgccggtgaacatctcgatgttgaacggtccgtcgttctcctctaatccaagggcctctaccagatattcgccctgcttctgtcctaccatgtagttgtcaaaggttgcgtaatatgtaacagcgtcagagttcatcagaagcctgtcataggaaataacaggtatgcctgcttccttggcctgtcccagaggctcgcccagagagcttccgtcgatggatgcgatgaccagcagctcacagccgttggaaatcatgttctctacctgggatacctgggtctgtacatcgttgctggcgtactgaaggtctacctcatatccggccgcctccagctctgccttcatattgcttccgtcctggttccatctctgcaggtccttggtgggcattgccacgccaaccaggtgcttttcgccggatgcagcctcatcctttgctgcttctgtctcagccttggtgtcctctgctttggcgtcctctgcctttgcttcggtctgggcctctgtttttgcctctgaagcaggagcagctccctccttacttccgcatgccataaggctgcctgccatggctaatgtaagcatggtcactaacaatttctttttcatattgtaaatcctcctccatatgttttgatagtttaaatataccacagcccgctctggacttgcttggcacccatctgcacacttttaagaggtttaaaaaaatgccctgcaggatacaggacatttttgctcagtttattttatttttagttaaaaatgtgctatcatccggctgtacaccctaattcacattcaaatacacatcctcctttgcatgaaacccgcccttaatgataacctcgtccatgttttcctttgtgacggcaatgggctgcagctccaggtaaggtacgttataggtgccgtcataggcagtgtcctgcacctcctcgatttcctcccccaatcccaggagaaccgcgcatttggctgccaggctggcctcctgttccacggatttaaaagccgtcatttcctgggtttcctccacgatgcgctgacaggctgccaggtcgccgtcctgaccggtcacgcacacctttccggccagccgttcttcggacaaggccctaaaggcctggctggccagatcatcgtttccgcagatgattccctttacattgcggtccagctttaatccttccttcgtataggtataggcgttttccgcaatccagccggggcagttggcttcatagaccacattgagattgctgccggccagggtctcgtcaatcccctcccggatcagcgaaacattgttgtcggtcaggggcccctgaatcaggaagatatcgcctccatccggaatgttttccagcatgctctcagccatcagcctgcccacctcggtgttgtcaaacgatatgtataaatcgcacccggcattcattatgagccggtcataggaaaccgtcttgattcccgcttccctggctttaatcatcacatcagacagcgcctcacagtctcctgccaccaccacgatgacatccacctgcttcttaatgaaatactcaatctgggaaatctgttcctccacatccccgttggcattctgtacattgacctccgcccccagctcctttgccgcagacacaaacacatctctctcccgcatccaccgctctatgacaaaggattcaaagctgagaccaatctgtacctcctgctcctcctgctccacactgcctgccgccgcatcctctgtcttggcgcagcctgaaaccgccaggactgagaacagggctgtgagcaatatgcagacaatgctgcctgcggtcctctttttatgtatacccatatgatttccctatcctttcctaaatccgtcctaaacctgtccttaagccttccctgccccattctccatccgttccctgtactcgctgggattgacgccctcgtatttcttaaaaatgcggctgaagtaattggggtcgctgtatcccaccatggcgcatatctgcttgatgctgtaatccggattccggaggcagacacaggcctgtctcatcctggtccgtgtcaggtattcaatgaaattttcccctgttccctgcttgaacagcttgctgaaatagtaagggcttatatttaccatcctggatatctcgtccagggatatatccttctggtaattttcgtcaatgtattttctcaccgtatccaccaggtactccatctccttctttttctcagtacccgcgcattgacatatttcccgtgttttttccaggaaccagcggcacaatttgtcgctgtcagatgcctcttttatctcccggatataactgcccctgggctttaaaccgaactcagtgccgtcctttgcacatatccggtactccagctgcatgatgagctccagcaccttggcctccaagtcttcacggcagtcataccttccctgcatacacgaaaacagctcggccccgcaggcagcggccccttcgctgtccgccttcagtccccgctcgtaataactgttttccagctcctttgggtattccccggccacgtcctcctgcctgcttgggatatccgtgatgtggaccacatggctgacgctctcccgcagggccctcagcgcctccccgtatgactcctttgcatttcccagagtttttgtgctcccgataccgctgcggaaatcactgccaatgtgttcctccagcttctggagcatggtcctggtccttgtgatgacctccaccctctcttcatatttaagcaccggctcaggggaaggcacaaacaacaccacccggtttcccatgacaggtccggcaatacaggaaaaataatccctcacgatttccctcatggcctgataatacttgttggcctttacgctggatccgattacattggtcagcctgccgctctcatccctgtctccgaattccagaaccaggcagaaaccgtaattctccctgattcccagcagttcctcgtagccggagctgtccgcgccgtcatcctgcagcatattgtagataaatccgctctcaatcatgggaaccacgatttccagcctctcccttattttaaggtcgtcgcttctcttctgtctggcttcctccacccgctgcatggctttcatgcatacgtccaggattatctttttattggaaatgggcttggtcagatattccataacacccaggttcacagcctcctttgcataggagaatttatcgtaggctgtgatgataataataatcatctccttatccaccttccgtatttcctggatggcctggattccgctgagtcccggcatatgaatgtccacaaatgcaatatccgggtgaaagctctccgccatctccacaacacctctgccggtcttgacacaccgtatatcgcattcacttccaaagctggtggtaatgatcttcttaagggactccagcataattccctcatcatctgccagtaatatccgaaacatgtccaatctcctccttcaccggaatatggatgatgacctcggtccccattccgggaccttcgcttacaatccggaccagccccttttgctgataatacagctccagacggctgaccacattgtccaggccgattcccgtggaatctccgtcatccggtgtttcctgctttctgccttccataacctcaagaattctctcttggctcatacccttaccgttatcccgtacgctgatgcggatggagtccctgcatccatgaaccgtaagaagaatcgtcccattctcttccatgccgcggatcccgtgtctgaccgcattctccacaatgggctgcagtatcatgctgggcatcttcacatccaatacccgctggtctatggattctttaaactgtatgtcccctgcaaatctcacattcagtatgtagatataattttcagccgcagccgtctcatcccctaccgtggcatcctccaatcctttctttacattatagcggaaaaattccgccatcttatccaggaaaatgcaggttttttccgcgtcctccatcatggccagctgggcccccgcattgagggaattaaacagaaaatggggattgatctgggactgcaggtatttaaggcgggcttccttcaggtggttttccatcaggagctcccgctccaaaagctcctgctccttctcagccccctcctttaccttagccacatattcctccaggcttcctaccatctggttgaaggtcctggtgacaatgccaatctcgtcgttggaatccgtatccggcatctttacgttaaagttcccctgtcccaccagattggcggtcctggccagactggtaaggggcgttaccatatcctttaccagcatcctgagcaccataagccctgccagcatgacaatcatcaggattaccatgttgaacacctccatgtagcgaagggcctccctcatggtctggtagctggcagagttgtttttaaactgcagctcattgagctccgatatacgcgtgttgatgtactgatagagggtaagggccctctcatatgcctccctgtaccgctctacgtttcgcccccgcttggcctgcaccgcatcctgggtcatatccagataggattccgacatcatgcggatgttcttttccaggatttttcccggcttgtcaatggtcttatcgttcaggcgttctaacaatccctgatattcctgctggcttttgtaatagctctcaaggctgtccgagctctttacagacacatagtctcccatgtccttctgcacatgctccagggcctctgacagctcgcttaggtttacattgctggcatataccgtatccatcttgccggcaatcttgtttacctggagatagataaatatgttgcttataaataatgtcagtatcataagggtcacggccagcagtattttcttctccaggctcagatggctccatatgttctttcccggtctctccatactcatcgctcacttttcaaacaggctctaatccacattttcctttgtgacaaactgcaaatccacactgtaataggaatttgcgtgtccctcctgcagatattcctccaatgcctgcacacagtaccgccccatctgctccgtatcaatgacaagcgttaccggaatattccccttcctgacagcctctaaaatctgatctgacttgtaataccccaggagctgcagctcccccaccttattgtaatcaatcatggcctggtaggcagcctctgtatccacggcctctgtacacacaaggacatccggtactccctccttgcggaaaaatatgttccttatggtctcatccgcatccaccttcccggtggagcgcatggtttcctgtatgagcctgacccgtcccgatgtgtccggtgaagtcaccagcaggttattgatctgttctgctatctgcacctggctgctgttatccctgtcatggagcagaagcatcacctccacatcatccttatccggcggcaccagctttaaaatctgttccccgtactggcggcccagctggtagtcattgacccccacaaaacttatacggctggtatccggcgcatccttgagaaccgtgaccacgggtattcccgccttaccggcctcattaatccgctcatctatcttatggccgcccgtgtattccaggataattccatccaccctggaagcaatggccatgtccataagactctctatctctatggtggaggaaagactcttacccatcagttccaccagggcattgtgctcccttgcagcctccctggtgctctcgtatacatccttccagaaaggcatgtcacaatcctccacaatcatgacataatggtagcggtattcgtttccatcctccccgccgtccttctccacctgatttaaaacattctggtaataggagctggtgaccagtgtgaggaacagcactaccagtattccagcaattacaattatacgttccaagcgtacccgggttttcattgtttttctctgcctgccctctcaatcagcctctctatcccctcctcagggtaggacagaagcttcccgaactccacggcaatcctgtatctctcctgccctgtataggcgtggtctgcaatcaatcgtttctgttgttccttcagtcccatatagcgctccagcacatcgccggtccggtaaaagaggtaattatacttacccttattcaactcctcggggaataaatccgtaataaaagcctcgtcctccggataaagcttcaccccgtacttcctgcacagcttttctgcatcctgcaggtaggaatcccgttcctccctggtatcgcaggggtggctcatggccagtgtcttaaggccggctgacaccatctcgcagaagcagtccatggctcccagcccgtaggaataggcgtcaattgcatgtacagcctcgtccctgttcacaaactcatactcctccttgtccagagacaggggtattcccgacttactggtcacattcacgccgccataccatgtgctgtccaccaaaaagatatctccagcctggtattccatggaatattcatcattctttttaataatccgtatcctctgtccgtccataactattttcccccagccacacattataataaaatatcggtattcctctattttatagccacccccagttcctgtcaatccaacttacaaactgctccaaatttaacagcggtttaacagcggcttattttttcacactatcaaatctccccccggcgtgatataatttaattatcacgttcagactgcggtcttagccttagaaagacccggtacacggcaatggaatgatatacggggggatgattatggtattaagatgtttttcggctccggatgaaaaggtaaatctctgcttttatccctgcagctgcggcaccggaccgggagaccacgatacatactgccaagagtcactgtgcatttatgatacagactatacaaagctcctgctgtcctatctggaatccgaattcccggaatttgatgtctgttgggataaccgcatccctgccgggacctggaatatcataatacagaaaattgaaaatgacatgagccatattcatttcgatgatactgtttttgacttttacagccggttcatcagctggattgcagacgcactggagcaggaggacatgattatagtgaaggggaaccagtaagccccccacctccccaatagaaagcaatgttttctgtcaggccatctgctctgtctgcagcgtacttctgcatgacacactgcgctgatcatgcatattttatgcttcccagccataattgctgataaaacagctgacaggatctggtatcaccagctcctgtcagcttgcttagcgcaatcatagcctcaaatttacatctggcatgaatttacgggcctcccgctcttcctgttccataagccccttccatgcctctgaaaaatcctcccatcttttttcacgcagcaatttaattacctcctctgtaaatcccatgtaccgtaactggagtttctggtttctaatccggtataacataatgggatatccccaggtcagtaaaccatactgttttcgataacattcacgtatcattaccatagggcactggtgctcaatccatttaaagtacagttcaaaacaaagatgcaccttgttttcctgccttaacaaatcaaacttttcggtcaaacgctcctgttcctccccgctgcaggattttattgtatacaatgttatatccctgattgtcaaagcaagcagctggaggctttccaggtacaggctcattccctccagaatctccggcatcctgaaattcattttggccgtcctcattaccaccaaagtaccctttccatggaatgactgggtgactcccagctgggctaaaagcatcagggtacgccttacggtggctacggatacatcataccgctgtgcaatctggggtaacgagggcagatagctgcctatgggatacgcccccttcaccacctcccatatgatgcgcccggccagggaatatttaagctggggcctcctgcggtaaatattccattggaacggaatcctgttgttgccaattaaatacattccgccctctttcctgataaaaagggacatatcttccaccatttttttataagaaccaaagaaaatctgtctcaaccgggcaactatctcttctttggacgcttccggtttcagtgtttcctgaatctccagcaaattatctgtcagatacgggaaacgtaaatatcggatttcttcccagaacagattcagaatcagcttgtttttcagtgtgcccagtgtcaggctgtaaagctccaccagtatggatatgacccccagtgaagggcaggcaagcgcatttctgattttatcccagtcctgattcgtccctcttctcaatccctccagccacaacggccccataagcagcggaaccgaatgaatcatatcttttattccttcttccctgagggcaaaatattttgcggcatgttctcttatcttatccggttcagcttcatagacaacaattgccatccgttttccgtccatccttatatacccttttcgcccaagcagttccaaagcggattgaaccgctgtaggacccatatggaaaaatcgctctgtctccgcaatagccggaaggtgttcaccagttctgtacatcccgaacaggattctggtctcaaaatattcataaatcacacggtagagtccgtcatctgtatacatatattcacaaaaggccaacattttcatgagtggtccaatcctatgcggctcacttcctccatctgtagttgttccacgatatcgtaatatctcagtcgcagctccggatgattatattgtacaatgccttcttatctcccagtttgaagattagacgataagtaccttccccggtgttctcaggaactgtaatggttacagcagcatttccctccctctttgcgccgtctccctgtcccagctccaaatcgccgcttacttcccagccgtctgcttcaatatacgcaccgtcctccttccttctgacttcaacctgaattatttccgcctgcgtaatgtgttccatggagtatgataccgtaaatccaatggctgctccgggcgtggccacgcgttcttccccttgatcagctttcacactgaggccatatacaggattcgcttttacattgtaagttaattctgtaccggtaatcctacctttacctgcgttcacacctgctgcaaacagctgtgcgctgatgcggttattttccagcggcagaccggccgtatcagttgtatccatgataaccgtatgagcctgcccccggtccagaatcaaatataccctgccgttaacagggtagcagcgtttttctccgtaaataaacgcagtccccttgggaaactcctcaccctccggcgttgtgagcaccactgccgctttgtctgataaacgtgtatcctgctggggagatacataaatgctgatacggtgctcccctctggccagtccctcctggctgtccagtgttattgcagccgttgaattattgactgtaaaatacccgcctacggagtcagctcccgtgtcattgcgcaatctcaaactgtattcccccggcataagaccggctgttttgtcaaatgccgctatgactgtaattgttttggcggcaatattttcattaaattgactactcccccacatctctgcaaaattgtccagaggaatttttccgtccttctctccccctgtcagggtatagaggtagtatcggtttccgctcagcagtgtgagcttagcaccgtccggcagcgcgtgtctgattccactgctgtcctgcagctccagccacacacttgaagcggcgagggttccattctgacttccaagggtgaacaccgcagtaacagcactctcttgagatattaccaccggatctatatcattcataccctcatattgttttccgaatgccatctgaacagccgaaacaatagattctttccagtgaatattcagtgtgacgggaaccttattcccatctgcgtcagacagtgtcaaaataatttcgtctgtatccttaggcgcaaaagcaccatgattgtacagtacaaaatctataggggcctcataccggctgtccgttgttccgagtaaaactgtatcggcagattctttatacgtgcttatatcatatggttcgctcataagattcgcggtattccacccctggctctggacaggctgcagagtgactgccacatcataatgttccaattcactgcctacagctttcagtgtgattccattttcaggtaccttaacccctgccagactcaggtttctgctggaatctgccgggatcaccatcctgcccgtatagcttccgctctccgacgcataaaggtcaatcgtctgctccgacagcgcactggccttggtgacaacctccacattcatggttatctcctcctccaggatatcgcccgcgtaccgttccaccaccacgctcaccgttcccaggttctggcttatacgaattccatcattataataggtcagtttaaattcaatgttcggaatgcctgacgtttcctggtccaggacatgatattcccaatcctttccgatgattgaattactgttatctgttccggccgtctggtctgagataacatttgaaaccacttctgttttaccggtattctgccacatcactaaaccaaaagtggaagccggtgtgttccgtatcttcgctttttcctgctccgcactcacatccggacctgatgtgatccacgttcctgtttccaggttcattgccgcgtccaccagtgtcattttgtctgacagcgtaattgatttgattgcatatctgatattctctgtatcaccaacaggcggaagctcgatggttccctctgccgcggcaaagccatcctctcccatccccaggctgtctgaattgcgggctgtcagcacaacgtggcgtgtagcgccggcattatctcctgccaccttccagtagcggtacgacgtgcctatatttgtgtatcccagctccgtcttttctccgggaaccacaaaacctccgtctgatggattaagagtctctgtcttcgccctggcaaacgcatatgcatccgccgtatcacctgcaatcatataaaaatatcctgtaacggctccatactcttccgagtccccctgggatgtgttggaaatacggaatacagtaccggtggaaagtaccactgtatttgggcaatgcgcaagatctgcctgggttaccaccttgctttccgtttcatccacgcttttcagatttgccacactgttggacgccgaatccaataccagggtacttccgccttctaaagcaagactgtttcccagttctcccaatttatcaaaattccctttatccccaatccggttcagggaatagggagttgtctgattcgagttggcaacatcagactggccggccagccggacatgagtctcaatcaggcgtacctgatctgctctttgtatggatgtaactgtacctgtaaccagttccggctgtccgccgccagaggcagccgcgccaaaatgatccagcgttaccagacgcacatcaccagcgtcgcaggatgcaccgcttccgaacacaccgcccgcaatctccatctttttgccgccagtatcccccgcgccaaaactgtaatctgttccgtcaatataaacatgagaaaaaccgtttactgttatggtatcataattcaggtcagcgctgtcaccgccgtaatcaccgcccgcataaacggaaccgcccacagacaggccggaggcgtctaaaactggtttttcctctgcatgggatttataatagttgcatttatcaatggctcccagtccaatatggacatgggtggaaccattaacaattccctggaaacctccaccaaaaaccttaccgctgacagtaccgcctgtcagatttacaaatacaaggccggacgcggatttctcatcctgttctccgcttttaccgtcattactcagctcgcttcctccatagacattcccgcgaacccagccgcccgtcatattgaccgtagaacccccgtaaacaaaccggtcgcctacttttcccagcgcaccaccatatatggagccgtttacggttccgttggccatatgtacagccgccctcccatgggtcagccccgcttctccgccgccatagacgtttcctttgatggttcctccgctgatgattacatttgttgagccctctacctcagctaccttcccccctccatagacataaccttctattagtccgccttttatttcaaccgtaacctttgagttcttacataccctggcagatttttcaaacccggccttattgactccctcgcctccgccgtagatattacctttgattgtacctccatttaccgtaatattggcctctccatccaggtatgcatttcccttgccataatccttttgcgtgtacccttggccgcttgcatatatgttacctgttataacagcgtcattgtctattgtgatgtctgcctttccggttaaactgccgaaatcagctgctggggttccatttgcatcgttgccgccatcaactcccgcctccccgcctacgcccgcggcgtatatattgcctacggttcccgctgacacggatatatttacctttgttgcatcttcgccgcttactacgtatgcagcagagccggagccatagatgtttgaaatacttcctcccgtcacaatgatgtccagaattccctgatacgtcgggatgcctgttgcccttcctgaacctgccccgtagaccatattaacagtcccgccggaaatattaattgatgttttccccgtgtacggcgccttcacattgctgaatccctggcatccgccgattattttgtttactgttcctcctcggatatagatgcctacattcccgttcttaatctccccgctggcgcttccggctacaatggtgtcaacttttgcagttccgtccacaatgataactgcctcgttgttatttgcgtcaacagatccattgctccgtatatatcctataatcctggcaatactgccgctgcggacctgaatgatacccggctttactgtcagagtaccatcttttgatgctccgtacaaatacaatccactgcatgaaacattatcccctatagttatattgtggccattcccatatagatggttcatcttttcaatggtcagtgaatcaaacgtgatatcctcatacaaatgaaactcactttctgttcccgctgcattactgaaaaattttatgtcttctgtaattcctttgattgtcaccggaaccgcatgttctttcagaaaatcagttgtattgccatagtcataatcttgcattaagataatctgattaccgtctgacgttccgccatcttccctggtttttaattttttcgcagcagcttccacggttttaaccggggcattttccaaacccgaattgccgtcatccccgctgtcctgattcacataaaccgtttcaagcacagccaccccgtttgcaggctccgagtacaatgtaacagagctggccgctgtcatgcttctggtcatcttcacaggagtcaccgcgcagcggaaccgcatttccatatcccctgctttcacggaacgtttatatacaggtgagtcctcacctgcaatatcttcccatagaccatcgtctccatttccatgattatcagtcaggtttacatcttcgccgtatgggttcttatcatccgggatatccgcgccctgtgctgaatactgccattgatacaaaaaggcatagccgtccatgctgtttaccgtttccccggtttccttatcaaacagggtgtagatcgctgtcccgccctgccgttctgccctgacgcccatctgatatgttccaacgggcttccagacagaatacaggttgagatgctcctccccagtatccgtatatgttcccggaaccagtgctttagccggttctgtccctggttctaatgtccatcctgcaaatttagcagtaaaaatggcattgtcatcccatgggcattttatttcttcaggacattccggcagacacacctgcccttcacaggccggaagttccatctccatcatatcatccagaattaccgtaatacaactgtccgccatcacataacctgcatattccgccgcctcaataaacgtaccattctcaggagaacatatgaccataccggtctgcccttcatagaaaacagtttccggattctctatcttctgctgtgaaatatattcaatatcatagtccggattttcagcttcaatgttttccgttaccttttgaggtctgctgtccttaccgcccgttccgttttcactttcagacggcagctcctggttatggctgccctgtccggctgcatcatccggcttatctccagatgttccagatgtatccccggcctcagtattgtccccactgtccatactgtcatccttggataatccgccttcctgtccgctgcccgtgtcagggctgcccccgccaccagcgtccgcattatcaccgccggtatccgtactaccgctgtctgcatctgtattgccgcttccggtatctgtactaccgctattggcgtccccactgccggtatccccgcttccgctgtcagtgtccccatcgccgccggtatccccgcttccgctgtcggcatccccgctgtcaccggtatccccgcttccgctgtcagtgtccccaccgccgccggtatccccgcttccgctgtcggcgtccccgctgtcaccggtatccgcgcctccgctgccggcatctccactatcgtcaccggagtctgcgcttccggcatccatgccggactcactgccagaggaatccgaatccccttccggcattccttctcccacgaaagggacctgatgattttcaattctagctatcgcagaaagtgtatccctatgtgccgtctcttccggttctgtccgctccgcttcctcttgctccgtctcttccggttctgtccgctccgcttcctcttgctccgtctcttcctgctccgtctcctcctgctccgtctccccctgttctattctatccggtttccccggttctgtctccccctgttctgtctgttccgcagtttcctgcttggtttcttctctatttccttcattaacagcgttctcatctccggtcttatccgcttctccgttttgctccccttcttctatccgttcctcagaagttactttcgcagcctgagacggggtcgccaaagtgacggtctcactttcttcgggctctgcttttttccattctgtgatttctcctccttcaaattcgtttcgaatcacagtgaaccgtgcggcctgatccggactttctccagaaaacgcataatccccgattcccacaatactttcaggcagtataagctccccctgtaatccgcccagcccataaaagagacagctcccaatataggtaatcccatcctcaatgaccaatgtccggatttcatctgcatattctgcaaatggagccgtatcgcaactgaaatctcttgtatcgccatatcctttaaccgtcagtacgccgtctttcagaacggctttcacatcactgccaatttcaaaggttctccggtttccttctgttgcatatgtaagcatggacccgaagttcagattgctcaatacaagagaaaaaataaggcaaaacgccagtatgcgctgccggttgtgtctctgcctcctcaattgaaatttctggcgtttcccatccattgcattccctccactacataaaaaattgactgttattctggttgagccgcagtattatccgccggattggcttaaatcaattgcatcggcaaatgagtccttacccgataatcctatatccgcctctgatttcagcagtaccaatgaataaatcccgtatccgggcgaatgaaatgtgcatttattgtctttataaccagtgacccggatatccgcttcatccggtatcacacctgaaggcaatgtgacggttatatccttttccccgtccgcacataccatggtcagcacagccgcgttgcggccgctctcatcctccactacatactgattacccagctgccttttaaatacacccgtaagggttttcttataaggaaacacagattccgccaccactcttatttcctctaattctactgttcctccgccgccttcaggtttggccgcgggaatcactgaaatcgtcacagtgcttttttcaccggcttttattgttccctgaatcccggtatcgcctccctcaaccgtgcctcccgtcacactcaccctgtatgttatatccgcagaggttacccgctctgaatccgcaaagttatagagttcaattgtgaaggactgcgccattggatcaataaaatacgccgcagttcccccatcctctttcagcaaatcactggtaaagtaaaatgtctgtgcttccacaactccgctctggctttcctgtttcatataacgcgcagccgctatgcctgccagagacagcataatccccgcagcagtaatcagcataagagccgccctctgccgtttcctgcggattttgttcatcattagacgcctcctattcttgtatagccggcacagtctgttccgagctgactgtcagtgtcaccaaatcaatctcatccgtatattcagtccccgccttgtcctccggccatgaaacagccagagtatatgtatgaatggcggaaactgaatggggcagacggccgccccggacagccgccatcccgccattgaaggtcaatgttccattctctcccgtattcacgaataatccctgatgatcaggattactgttgtcataggtaagagcaaagtccaatggcagattacccgttgtctcaactattatggaataatcctgtcccacttcacttgtgactccattttccgtattggtaacctcaaaaatataggtttttttatccccaggccgcagtccgcttacattgatatcaatggtactgctgccgctgccccaggccgccaccgtggcagccgccatgccattctcctgagccgtaaaccgtgcataggagaacgaccatacagatatgcttgcggccgcaagcagcaggccgtatcctgcaattccggttttcgtcaaatgctttcccattcttatatgttccctccagattgtttgaccatcccaatcatatccgccccccagaaaaactgtattttcccgcccgccttataaaaccgtccttttcccgtgcatgtatctacggaccttcctgctgagcccatattttaagcctgaccctataatcaaggtctgccttgcctgcatttgtgtcaatcccgtcctttccactctcataaggccactgccactccaaaagataggatttgctttcacctgcatccaggcgtacggtatcactttccgcagcgccgccgttttgtgtatcccaccaatcggtaagcggctttctgtctttatatgtaacaatacggaaacgcatgggaatgtgtaagctgtcttcctcaattgataaggtaaagataacatgaaaggaattattattttcaagtataaacgggtagcttccttccgcgcccggcaaaagggtctgcacatttcccgacaaatcggaaaacaattctatttcctgaccttgtgtccagctcacacgaaaattcggaatcggtccttcatctttgtcatctccgccgcctccgttatcaccgccggtctctccaccgctattgccaccgctattacctccgctgcttcctccgctattacctccgctgctgtctccgctgctgtctccactgccgcctccgccgctaatgcctcccccgtccttgtcattgccttcgctgctatctccgctgctatctccgctgacgctgccgcttcccgcattgctttctccgccttccccggatccaagtccggcattaacaccgccgctgccattcccaatttgagaggaatcattacgttccgccgggttcgtcccagtgtcatagccgtttcctgatacactttcattcggaccggcgggattatcttgtgtatttgaatctggaccacttgtacctgtcccgataggcgacacctgattatcaccggatataacaacaccacctgctcccggctgtccgcgcagcccatctggtgtaaggattacggttccattcccgttcctctcaatcatcgtttctccaggaagtaaaatattcccattttccagcagtttggtcccatcaggcaaagctgcatcctgttccgggtaaatcacctggttttccggggtcaaaagagcgagccccaaaggtccctcacttgccggcgcaaccacagttttgtctgctgtaatcaccagaccgccgggcgtgacaagtgttccctcccaataatacgcttcccctgttggtgtcacaagacggccgtctgatgtcaggtaggtcaatttctccggattaatatacagtgagttattcttttcatccagctcgattgccacctccatcagcctgacatcgactgccacctcaatggtatactgcccgttttgctgcaggctgacattgactcctgattccgcctgagccgaaaaaaggttgactttccgttctcccaaaacattacccgtacggtccaaaatacgaatctggtgctccccgccttccacatgaaaaaacgtaaagctcccgtttgtgtccgtaacggtttcccttggttcactgtgaagctgaaccctcccctgagcatagggcctgccattggtataattaatttttcctgccagatgaaatatctgctgcatctgctgctctgctgcgtctccatcaggtgtcagaagtattgtgtcgattctcctgcctgatgattcgggaaatgcagatctgccgagaatatatcccgccgcacaggaagacaaaagcataagtaaaaataacaacagtaacggaatccatttatgattccctgtcttcttttcaggagcaaatctgtttccatgtttttttatcatatttgccttctcctctgctgataaccgccgttgatattcggtctatgagaaaaaacgcggcgacttgccacgttctttctcttgggctgaatactctgaaacatcctgcctccggcacagggaggcggagttagttacactgttggagctgttgtttccgttggttttgtctgcgtaccggtggctttaatcttcagcttccaagactttcctgcatacttattgtcgtttttatctgcttctgcggtatctgcgctgccataatcccatttccagctgacggtaatggtccttttcatagcagcgtctcctgctgcatgctcaatttttccttctatttcactgcccagactataatctgtaccatcaacctggaacgccaaatcatccggtaaatccggcgtatccggatcagatgacttgtcaattgtcacaatataatcaatacccacatcactgcccgttccgtccagcacaatgtcaaatgatccctgtgttcccggagcaatgacattatcaccaatcgtttcccccttataggcagttcttcccatatcaattgaacttagcgcagctccattatttccggttgccttaaactcccaggcagccactgttgcctctgctccgccttctacctcagtaacaaactttgccagtgtcccccctgtcagacaggttgtcatcagagtcaataccaaggctaatgcaccaagacgtgctacataagatttttctctcatatgtattgtcctctctttcatttcaaactgggaaccatatataacagcccagacatggttcccaagtgtctgaatcactgcacccaggtattcctcctggttctataacggcttttctcacactgtgcctgtgaaatcagccggtgcatcctaatttcacttactgtccggatctcccttttctctggacctgtattctctcaattctgcctccagagcagccctgtgttctgcctcctccctgtcaaggcgccttcttctccagatatcccacagaataaacaggcacaacgggcatatcataaacagaatcattccggctgcagactgcatgaacataatcccgctacccatcccgggaattttacctccgcgccagattccctgtacctggtccgcgcttacggcctgccggtctgctgtattgttcccatcgccctgcgtgacataccgtacctgcccatcctctccctcccgaattcctacaatcctgtgtgtaatggcctggccggagtccagataacagatcacgtcacctgtctgaagccgggccggatccgtactatgtaaaaatatcatatcccctgtctgtatcaccggctccatggagccggacaggacaattgcaggttttataccaaatactcccggcatctcaccgggctttgtgtaggtgctgataatcaatgtcaggtttataaaaatcaccggtataaagataacgcacaatatcccgcccataacggaccggactgagatcttcctgtctctgctcatttgccctcctcctttgaagaaatgtcatgctgcagcttctgcctgagccggaacatctcccggcaggactctatataagccatgtcatgttcctgtgaatcccctcttttctcttccggagcagccccatttgtaaacacattcacaataaactggtttctatcatgttccattttcctatgcgcctccccccaatgctcagccccgtccactccatggtcccggatctaaggagggcggcatatcaggattaagtaaaacatacaataataaagcctgcgctgcatacacaggccggcttcacaaatcatgcagctggctgacacctctttttagagagaaatccctgtagctttgcgtcactagctttcaccagttttgctaattattttttatatcattggttttcttaaaagctgcgtctgctgaggatatcacataatatacattatgtaatagacttccgatgaaaagcataaaaacgctttcatcgggaacctttgctatatccaaatttaactctgctcatgtgttttgggaaaaataatgaaaagtcagaggccagaaactggaaaactattgaaaaaagctgactttagatgcataataaaaacgggatgaggatatccatgttaatgactatgacataatgtatattatgttctggtcatttttatatcagcaggcacatccttgacaatacacgggcatgctcctcttcactggtaaatgtgtaaattctggtatactcaatattggagtggcccaggatatcggccagatgcacgatatccttctgcatccggtaataagtaaccgcgaacagatggcgcagattatgcggaaagactttttccgggctgaccccggcctctttgcacaatgccttcatttctgcccatacattacaacggttaaccggtgtaccacttttggtgacaaaaacaggtccggagtagattccattctgtctgcagtattggagcaggcattttttcagcttctttggcagaaagactacgcgctccttgcctttgttgtaaatagtgattcttcctctctccagcgcctccctagtgataaaacggtgctcgctgacacggataccggtactgcatattgcctggatcataagaaacaggcggctgcttgattttgcctttgccgccaggatcagcctgttatattcctcttttgtcagctctttatcctttttccgaaatggatttctctgtatcttaaatagttttacctgacagtccttttttccgataaaatccagaaaacggtttacagataccagcatgctgttggcgcttgttgttttgtatttcccgatgattgcctgcttatatccaaccaccacttcttttgaaatctcttcacggtcagacagccatgataggaaggccaggacatcccttccatatttttcaatggttgcagcggaacgttcttcctccaatagataatttcgaaacagacatagtttttcctgaaattcgccatatatattcatacgtttctttctcctgtcattttttgtgccattctgtattatcctaacataaaggtatgtccatggggaaggtaggggtattttacaatttctggtattttagcatctattttttgtaatgctttcatatgttagttttataggtcctggggcattttgcgcccttttaggacataaaaaaaccagttcaccctaatgatgaactggttgataccattggccggtatctgccgtgcctttttcactgcagcctataactgaaaacatgctggggattccgccgctgctgcgttgagcctttgttctatgtgaattgcacctaccatttaatttgtatacttgccctttctcacatcccaaccagctccagcgggcacgtatactcttccctgattttcatatgccccgtctcacaccctgttttcctcaacagccggcagtatataatccctgaccagcagccacctgttcttcgcctccggcacaaaaccggacgcaatcgccgccaccaggttcctgtcaggaacccagcaaatcatgttccctccatctcccatggcggcgtggacagccactccctttttctcaaaccgccaccacatataaccatagcggctgaaggttctcttcacagactgacggacccatgattcagaaatgatacgcgctccgttccacctgcccatgttcagatacagaaggccgaaccgcgccatatccctgggagtcatggtcagcccccatccgcctgcggtgacgccgtcaggatcgtgcacccatcccctgactccttccccaaacagactgtcacatgtataggtttccatgggataatccggaatcaccgtcattccaacaggctcaaacagatagcggtttgcaaattctctggtactcatcccaaccgcccgctgtaaaaccgcggataaaagatgggctcctgccgtacaatattggaaatacctgcggggtttaccggtttccctcacatccctcatcatatccagggtgaatcccacccagtcgggagatgtacacagctgttccaagggttccttccattcctcaaaagcatagggcaccgtcatagtcagcagattttcaatggtcacattcccgcagttcctgttatgtgtttccgaaacatagtccggtaaatactccattatcttccggctgacagacggtatatatcccttgtccaccgcaatgcccgtcagcgcggacagcacgctcttagtcaccgatgccacatggaccggaacatccggtccaaagccatgaaagtactcctcacagacaatacagccatttctgaccaccacgatgccattggtatttgcatattctgacgtgataaccgaacgcagtttttcaggtaattcccggtccatgccctgctccccgggatctgttgtccgccactccgggacaggccaattttcattttgcatcatataagctccttcacgtttataggtacaccggtgtatgaaaaaagcatataatgattaaaaatgaaaagcaagaacatttttaaaaatgataacagggtactatacaaagcactgcacatcacaggacatgataatggggaatgatgtcctcataactcccatccttcataaggaatcctcccggtatcacgcccaactgtgtaaatccaagcttttcatacagatggagcgccggggcattactcttcaccacagcgttaaactgaagtatcctgaaacccagttttttcccctgctccatgcaatgcttcaccaatgcctctccgatatgatgtccccgcagctgggatttaaccgcgtagctggcattgcagatatggccgcagcgccccacattattgggatggagaatatacaatcccacgatttctcctcccccaccgtcatatgcaatccctgtaaatgactgctctgaaaaaaaacggttccctgtctctgccgtaagaagctccagctgcggaaacgccgctccctcctccacaatatggttccatatcctgactgcctcttctgcgtccgcctctgtatactcccgtatcctgatatccatatctgtaaaatcccctttcctttatgtaaaatcattttccattcttcttaagcccttactccgttactataaacaattacaagcggaaaatcaaggtactcagctctgttttgcggcattgacggtattctgaatgacgttaaaaatggcctgttaacgctttccaatacctgccatgttcaaaaggactgcggcaacaatccattgcagcagtcctcttaacttttgttttttattttcagttttctgttcttcagcctttatctctcagcttctgtcttttatctcttatccctcagcataacatcatgtgccccgccttccacaatactggtggaagataccagggtgatttttgccttctcctggagctccggaatggtaagcgccccgcagttgcacatggtggagcgcaccttgctcagagtgaggttcacattgtccttaaggctgccggcgtatggaacaaaggagtccacgccctcctcaaaggacagcttcttatccccgcccatatcatagcgctgccagttcctggctctggcgctgccttcgccccaatattccttcatgtagcttccattgacattcaccctcttggtagggctctcgtcaaatctggcaaagtaccgtcccagcatgatgaaatcagcgcccatggccagcgccagcgtgatatggtaatcatgtacaatgccgccgtccgaacagatgggcacgtatatgccagtctctttataatactcgtccctggcctttgccacctcaatcagggccgtggcctgtcctcttccgattcccttctgttcacgggtaatacagatggcgccgccgccaattcccaccttgacaaaatcagcacctgcctctgccaggaaccggaatccgtctccgtccaccacatttccggctcctaccttcaccgaatccccaaaattctttcggatatagtcaatggtaatcttctgccactcagagaagccttcggagctgtcaatgcacagcacgtccgctcccgcgtccaacagggccggcacacgctgttcatagtcccttgtattgatacctgctcccaccatataccgcttggagctgtcaatgagttcgttctcattctttttatgggtgtcatagtccttgcggaacaccaggtacaccagctcctggttcttattcaccagcggaaggcagttaatcttgtgctcccagataatatcattggcttccttcagggtagtggactcgtcggcataaaccagattatccagcgttgtcataaagtcctttaccttagtgtcaggtcccatcctgctgacacggtaatccttattggtgacaatgcctaacagctttccgttgggctgtccgtccgcagtcaccgcaatggtggaatggcctgtctcctccgtgatggccagcacatccgccagcgtcatatccggcgatacattggaatcactcaccacaaaaccggccctgtaccgcttcaccttgtgaatcatctcagcctgcttctcaatggcctgggacccgtatataaaggaaatcccgccttcctgcgcaagggcaacagccatcctgtcatccgatacggactgcatgatggcagaaaccatggggatattgatggatatgtccggttctgttcctttcttatattttaccagaggcgtcttcagattcacctgggaagggatacactgggtggatgaatagcctggaatcagaagatactcgctgaacgtgcgggaaggttcctcaaaatagaatgccatgttatttctccttttcaattttatatttattctccgccgaaccttgtaactggtactatcatatcatgcccccatatcttccgtcaatcaatgagcggacgttctccgtcatgtattatcatatacgcagcagttccaggcagagcgcctctttgcctgaagtccggcccggccgtcagtccatatatacccgcgacccggtggcgcccttctgcccctggtattttccattgtatggtttcagggctgtgtcatccatttccgcaaacacaagctggccaacccttcgtcctgccttcagctcaatggcacagcggtttgcattaaaaagttcaagggtaatttccccctgaaagcccgggtccacccagcccgcattctgtatgaacaggcccagacgccccagggaacttctcccctccacgaaagcggtcaggttgtcaggcagggaaacatactccatggttgtggcaagcacaaactggcccggaagaaggatgtatgtgtctgtatttatggtcttgtatctgacctcatcctttaaagtaatgattcccgtggataaatcctccacaatactgaaggtattccccagacgtatatccacactggccggctgtacctgctctttatctaacggcgtgattgacaaggtacctgcctccagcattttaaatagtgtcctgtctgataaaatcatagtgtctccctcccatattaagcgttactatattttatcccataacccctgcgccggcaatataaatttaccaatcattcttctccggcttccatgaaaataaacagagccggttttccccaacaggaaaaaccggcccaatctgccgtttctctatttacagggcattattctgccctgcattatgtcatccagcatatccttacactcatcatatgaatccacaatcaaatcagcttcacttacatcctgttggattcccgaaccgcggtacgccgccacccgggctcctgccagcctggcggcgtgtatgcccacagcggaatcctcaaacacaatgcacttacaaggctccgctcccagataatccattgcctttttatagcactccggatccggtttatggttggcgcacatatcgccgcatatgacaacatcaaacagcgcggtcatcctcatccggttcagtgcaatcataatcagccgggtggaggtagaggtcaccagtcctgtcttcattccccggccccgtatctcctgaatcagggataccacccccggcatggggcggatacagctgttttcgtatgtatttcccacctgccggcgctttcccgccaggtcctctgccgtgaccttgaccaaagacctggaaagcaggctctcgattctggttttgtcattggtaccgattaaggccttccggtcatcatccgtcagttggattccaaaggccgacagggccttttccagatatgctgcattgctctcctctgtatttgcaataacaccgtcaaagtcaaacagcacaaactccgtttccataggcgctccgtctacagagcgaacagcctgcgggcattggtctgtatgtacgcaatctcatccctggaaaggtcgcagaaatcgctgttttccatggagcagttggaatcctggacatacatcatcttagtatccttctgggtgatggaatagaaccagcactctgccggcacattatacaccttcccctgctccatcaaagtcagttcaatctcaaacccgtcatccgccttcgctgcggtaatcagaatcgcctttcccgctgccagaataaactgttcatccgtagaatgatggatttccaggtgggcaataccgtcaatgtcattgtcaggcttccagttcttgatactgacaagccacttttcatttttataaacacacagaataccttcaccattattttcatacacatccggtctcattatcatttcctcctaattatgagcacttagcgcagcggctggttatgagcacttagcgcctgttcttcagactcttacatgcgatacatgtcactggcacctgacccctatatttcagtcctcccaagaacaggcacgccgtagccaaacgccccttctttggcgcacattttagccgcaaatgcagctcccttcttcatggcttccaccagtctttccttcatgcgatcctctgtgccctccaccacagcacctgtctgcgaggtttctaacaaagagcacaggaaggctgcaaagtaagaatcacctgcgcccatggtatcgatcacatcgtccgcatggacagcgggcgcatacaaaaagctgtcatcatacagtacataggatccgtcctccccgatggtgccaaggaccaccttaactccataagactgtaccttcttcatctccgtttcccgctcctgcctggtcaaatgggcgcaggagagaatggccaccgtgacatacgggcacaccttctccagatacgcgtctgtccatctggtggaaaaatcataggcaatggcaactccggtttccttaagactctttaaatcatcttcgatgtaagaattcaaattagtataaatcagattaaattggctgatatacgcaaaatcctcctctgtaaaatcatagccatactccctggcgactcctcccttattggagcccagaaatacccggtcatttcctttcagcgtcaccagggcaaatccgttctcgccctcatggcagcggctatggctgtcgtcaatccctatctgcttcagtgtatcccggacacattcagccacctggtcactgccgtattttccaaggtaagcggtataagccccgttgagtttggcgtacacacatgtattgacacactggccccccgggtacatcctgcctctggaaaggtatttatcacagacattatctcccaccgcaattattttgtaatccttcatttcatttcccgctttcttttatttatatggattgaactgccggatgatttccgtggcccgtttctttcccctgtccatacattgggatatggattcccccaggcttacaccataggtaaatgctgcgatataggaatccccggctcccaccgtgttcaccacaggcacctgttctgcttccttttcatagaaccggtccccgtcataggcaaggctgccgtgttctcctaacatggcaatcacagtaccggtgcccttttttctcacttttaccatgaagtccctgatatagctgtcgtccctgtcataagagaaaaatgcgtagtcaagatagggtaatatcaggtcattgccctcctgctccagccgcttggaaaaatcatacacccaaatctgcccgggctgctttaactccttaatatagcggtcaatcctggaccagcgctcagcgtatacaatatcaaaggatttcacaaattccaggtcctctcctgaaagttcaatctcctccatggcattcccttcaaagtgaagatgcttcttatccccatccacaatatccatggtggccattccggtggggcggtccgcgcgtttcagcacgcgaagggctattcccctctccttcaggcgttcttccagagccatggcaaatacgtcattgccaagaatggtcatctccgtcacatcaccgcccaaatcccggtaattaagcgcaaaatcaatgctgtttccggtgaggtaataccggtccagcttatagtacacatcaatgcagttatctgccattgcaattgcccgcttcatgttctattccttcctttcccccacagcgtatatcatataatggcgcattttgattccgtcgtattcgcagaaataaatatccgctgcatggcccagcttcagctctccccgcacaatgggaaatacacagtgatttcctgtcagcagggacttcagatgacccggtgtgtttcctccgatggtcccgtatgtgggcaggtaatggttatgatggtacggatagtcctccggggcaatgcggcttaagcattccataatgtctttttccacacagtccaggctttcattgaccgtgatgcccgtggtggtatgctccgtgatcacatagaccagcccgttctcaatcccgctttcttccacaaacgctctgacctcaggggtaatcttaatcatctcaaattcccggtccgcgcagacagctgcttcctttagtttgaactccatctatctattcctccaatccccaaagggtatgcccggcatttttatgcatgtcccaaaaacctgagggcatttttataatatatgttctcaagggtttcggaagagaaccccagactgtccagtccccgcttgcaccggacaggccggattctgggcgaaccggagccaaacatgattttacgggaaatattatgctccacccacagctcccccatatcttccttaaataccttatggtatatctggtaagggccgtcaaaattcatcagcgccgtgcttgtataacaattttcatatttcagaagaagggcggctgtctcctggacccagggccaacccacatgggtcaggcagatattgatatccggatatctgcagcatatctcctcaaaatcagctggtctggaaaaccttgaaaatgcctgctgttccaggctaagtcctgagtgaaagataatcggcctgccaaattccctgcatatgtcatacagaggcgtcaatctctcatcatagggatacatgtgaagcctggccgtattgacatacaaccccttcagtcccagctcttcaaatgcacgtctgagttcatccgccccatccttatttcccggatccgccgccgcaaacccgataaaaaaatcagaatcacaggctgccagctgcgctatctcatcattggatatggctggttcccctgttttagatgaattgtcatccggcagcatgaaaatcttctgtatatcggccagggcatactgcttcttcagcaaatccatgtccgaaggtcccatcagatgataattcatctcatcgcaccgttttctgaatctgtctctgtcccggcagattggtccaaaaagcgcggggcgtatatgcgtatctattaccatgtctgttgcctccctgtctatcgcatttccagcacaaaggaactgctccggctattccttatccatatgcatcctgtgcatcagttccctgttattcaaatacaaatccctgtatatgggatattttctctgataaaattcatgtttttccctgtccggtccaatgattcttccctctggaagtttctccttaagctggtgaaaatcctttaaacatcccgctcccagggccgccagcatggcatccccataagaggaacactggaatgtttccggtatatgaaggggcattccggtcatatcgcagataatctgcatccagacatcattcttcgtacctcccccggctgttatcagggtatgcggcggaagccccatttccctaaacagcatcagatgctgtaacgtggaatatcccacagcttccagcgccgcccggttgatatgtttcctcgtatgacttcccttcagcccaaacatcatacctgtggccagcgggtcctgtatgggactgcgctccccgtatatgtaaggcagaatcatcaggccctctgagccgggctgaatttcaccggcttcccctgccatgactgcatatgcatttttcccgcccttacgttccatttccagctcttccccataaaaggtatcccgtacccaccgggtcagtgtaccggcagcgttggtgccgtcccccaggcagaacgtgcctggtatggtaaatacctttccgcctttaacagaaccgtttcctccggaggatatatagtcctgcaccatacgatccacgcagtagtaataaaacatggatgaaccatactggaaaaatgcagttcccggttctgtcagccccacgctgattgcctccgatgtggaatccccggtaccgcagataaccggtgttccctctgccagtcctgtctgggccgcagcctccctggtgacactgcctgccacatccgtggaatatgcacaggccgcaatctggtccggcctgcagtaaagtccgcattcctcctcattgaccgttccgtccgcccggtaaagaggccggaaggaacccttggccaaaaactggtctatcacatacctgcctgtcagctttgccgtgataaaagaacttcctgtgagaaatttataggtccttctgtatacctccggctcattgttcttaatccacagtatcttcgtggccgtgtcgccggaacagatgggatggccaaacagccttcgcacatccctgccgtaatgcctggtgagccactgtatttccttgtcagccctggaatcaatgccgtacaggatggccgggcgcagcggcctgcactgctcatccacaggcaggcagtccgtccccagggtgctggctccgatacagcttatctgttccggggcaataccgccggcttcaatcaggcgtctggatatcccgcagaaatccccccaccacaccttatctgcatcatgttcaaaccacccctgccttggatgactcattccatgggccatggtatgttccgctgtcaccctgaaatcttcccctatgagcattcctctggattcataggttccaatgtcaattcccataaaatattgtttcaatcatcacatctccttatgattccccgcggatctctttgacaatttccataaaatcacggacccgtttttcatccacccgctggttaaaaataccatcctttttaaaggctgagccaatgcatacagcatcacaatgtttcagcttttcccttacattctggtgattgcacccggtgttgcagaacaccggaacattcttctgcttcgctgcctcatggaccctggacagaaccacatcgtcaggctctgctcccgccgctgcccctgatacgcagaggccgtctgcaaaatccccgaacataatggacctggccaccacctggatatcccgctgcacaaggtaggcatccgcctccggattcaccttaaacaggagcttaaggtgctccattcccagagcctttctgtgccggacggcctctccgctgttagagacatagaccccatactctcccatatatgcacctgaaaaacagctccgcccaaagcgggcacctgttgccgccgccaggtcaatggtcgcaatgggattctttacaacgttgaccccaaagggaaccctgattctgtctttcagcttcccgattatgtatgccatggccgatataacggcaatatccgccaccggctggtacggcaggctgaactcgttggcaataagaatcccatccacgcctccatcctgcaatgccgtgaggtcgtgggccgcatggtccagtaccacatccatgtccccgcaaaaccccgggtcccccggaagggcatccagatgaagcagtgcgataatgggcttatctgctccaaacatgtcatgaatccacatatcatatctcctctaatacatcccctaattcatgggtatttttcttcatccaggaaacgatgtcgtcgatagccttatccgggtcacagtaatatctgcggtcacagatttcaaatgaaacggttccatcgtatcctcttctcttgatggcatcgtaatactccttcatggggaaatccccgtggccgggaaccgtatgccccctgtcattgaagtgtatatgcataagccgttctcccagatggtcgaaataatcatccactgtctccccggcatacgtcatctggtccatatccaccattccaacgatgcagggggagccgatttcatccagcatcctggctatgtctttgcttgtaatcaggacattggtggtggtgaccttcagctcctccaggaaaagccggacctgtttcctctggcagtacacggccagctgcgccagcgactcccggcagtatttccacgcctcttccccgggctggtcaaaataaccgaagcctgtactgatttggatgttagggcatcccaggaactccgccgtgtcaatggctctctgataatagcggatgctggactgccttgtcacaggatcctgggtacagaaattgacaggataaacacaattttcaggcgtcatagccattaccttcaggtttctctgcctgatatcccggtccagctcaatcagccggctcagggaataatcaaagatgttaagctggggtgccgagcagtaaaggtcgatgctgtcaaagggagagctctccactttgtccaggaacttttttatgggataacgtaaataatggtaattcattggagcaaatttcatataatggggcctccttctatatcacaagctgcgctttcacaaaactggcagcaccggagcctgtcataaaacccgtcacggctccggctgctgccggactgcattaaaagattacgcttccaagaagcagggctgccgccacagataccactgtacacacaagtcccggtaccatgtaactgtgattcaggacaaattttccaatttttgtagttccggccgagtcaaacgcaatggcagcaacacactgtcccgaagcgggaataaagtaattggatgagcaggcaatccagccggccactatgatgttagccggaaggcccagcgcaataccgattggcaccataatcatggttgttgaggactggcttgtggtaatggctcccacaatgaatacagcaataatataaatccatggatactggttggtcagggccgacatattgtcagtgatgaaggaggactggtctccgataaaggtatttaccagccagcacaggccaaatgccagtaccactgcgaacatacctgtacggaataccggctggtccagtaccttgtcgctgtcgagctttgtgataagaaccatggctgcggctgccaccagcataaagatttcaataacagttgtcagcggtaatttatttccgtcagcaagtgtaggtacaagaggcttcacagcgcccagcaagacaatgcctgccatggcaatgaggaagattgccacagaaatcttggcttcctttgtggcaggtctttcctttttctctgtctttgtataatcctctatctgtcctgctgcaacacgggctttaaattccgggtcatctgccagttctttgcccttcttgataactgcaagcgcgcagaccacggtaccaaccagggtggcagggatgcagacaagcagcagggtaaagatattgacggagccatagcctgtggcctcagccataaaagcaaggactgccacggtagctgctgaaatcggacacgctgtaatggcctgctgggatgaaacaatcgaggctgagatgggccgttcaggcctgacgcctgtctcaatggcaatctcattgataacaggaagaaggctgtatacaatgtggcctgttccgcacatgaaggtgaaaatataagccacaaccggagccagtacggtaatcatcctggggtttctgcgaagtatcttctccgcgattttaacaagatagtccagtccgccgcaggcctgcatggtggctgccgcacagattactgcaatcataatcagaataacggtaatcggcggatcggaaggtgttacatgcagtataaatgtcataatgaacattcctattccgcctgccatcgccaggaacgtaccaccaattcgtacccccagaaaaatgatagccagaacgataatcaattctatccaaaacataaattatcctcctaatcctttgtaaaatgtttcccctttatggtctaagaaatgattcaatcttttgttttaagaatggtgcgcacattcttggtaatacaaaagcaattcagttttgtatttctttgtattactctgtattgttttgtatctaatacaatagtatattcatttaatggatttgtcaattgctatttatcattttatatataatacacagtttttagaattatttttgtgcatatcatacaatcaagcccgtatcaaatgtatcaccattacaaatacatttaaatacatttatcccctagccatttgtctgccgccgttttttcgcgtcctccatcatcaggcccttatcctatgcgctctgaataccatgcaagcgcccttctcatggcatcttccggattcatgacatatctcctgtccagtatttccagtcccagataccccttgtagtcaaaggcttccagggtatgaagcgcctggtccagattcaggtttccatctcccggaaccaggtgcccgccgggatttccgtccacgaaatgtacatgagccaggttctcccttcccagaattccgatgaatgtttcaaatgtatccactcccgtggtggcaatcacatccgtatccccaaggcctttgagggccggacttcccaccgtgcgcagcaggcgaaggagctggcttgcctcattgcagatatgagtggtgtattttgtgaatggttccagagccagggtaacgccctccctttccgctttccggcagatttgcgaaaatgaatccgcagcccatttaaaggcatcttccccatccacatccagataggcaaacccggtggataccaccatgcagctgcaatccaggcacaccgccgcctctatgtgcctttgaaagaaatccacggtcctgtcacggtatctcttatccggatgggagacactgatgggatagacacattgctcaggcgtaaaacaggcaatcttcaggtgatggtcctttatggtcctgtttaattcacgcagacgtcccccatcaaaatcctccagatgcagatgaggcccggaagcccacagttcaacagactggtatcccagacggtttgcggattccagaaagtaatccagcgtatatcgtttgtaatggtaatttgctgcgcagagctgagaaattttcatacattttcctccttatatagcaaaataccccgcagtacgctgcggggtttgggccccgcgggcagagttccgggccgtatacggcttaaagcgtattaaaaaatactccggcacgctgcctttgcgggaatgaatgtcttatcgttttttcgctgtagcttaatactccactttccacatgtagcggcgtgtcacaaggggatgctcacgcttttctgcaagggcgtggttgtagattggatatacgttattaaacagggagtggttaaaataatccaccacagaagcatcaatggtagaaaggcccagctcctttgcgtccaggacttcaatcctttttgcataggtacgaaggaactttaaggcccgttcatccagcggacgggtggagccctccgaaatctgaatcataaacggacggtttgcatctgttatctcaaacggaccgtggaaatactctccggtatggatgctgctggaatccagccactgcatttccatgaaaatacagatgctctccatataggcagcgccgtaagcagccccgcttcccatggtatagattacaggatcgtttttatacgtttcggcaaactccagggctctctctgcaacatgggcacgtgcattcttaatgatattgctaatcatgcccaggccctcctggaacttgtcatagttttcatagccttctgtctgcgcagtcagttcaaccgccaccaaaagagcacatatggttttctcccccgcatagtcaatatcgcctttaagatggtccgggctggcgtcaaacgcataacggatgatatagtcgccaaattctatgatttccgattcctcaagccaggtcagaacaatgacagcagctcccttttcttttcccagctttgctgcctcaatggtttccggtgtattgcccttgtgacatgccaggcagatgatggaattttccccaaagtccctgggagtgctgtgaacgaattcattgctgttaatccaggcggattttatggaagcacactccttctccataaatgtcttagccggataaagagctcccagtgaccctccgcatcccacaaaatacaggttctttaccccgccctttgatttcttcgcttccaaaatttcagcaataatatttttgatatccgcgccaaagtatgccattgtctcaaatctcctttgcatattgtttttaattgtttctatatttatgataatacaatataatacttattgtcaataacaaattaattttttcgcaattatatacaatgaggccaatttgtattataatataactgagtattataacttaagggtaacgcggaggatatatatggaactaaataatacaattgctacccctctatacaagcaactggaggaaaagctgcagaaagagatagaaaccggcgagcggcctgccggaagccggcttcccacggagaacgaattaagcgaaacatataatgtaagccgtgtcacggtcaggaaagctctggccggactatctgaattaggttatctttaccgcaaatccgggaagggaacatttgtcgcagaaaaaaagattcagcggggtatcaccaatggggttttaagcttcaccgacatgtgccggatgatgaatgcatcccccggtgccaagatcacgaaaatagccctggaggatcccactgaaaaagagatggagctgatgtccttagacaaggacgaaaagatactggtattagagcgaatacggtatgctgacggaaaaccggtccagttagagctgaataaatttcctgagtctttttcctttttattcagcgaaaatttaaacgacagttccctgtatgagattctgaaaaaacataatataattttagaccattcccaaaaaaccctggacatcgttttcgccacctcaaaagaagccaaagccctggggatttcaagcgggtacccccttttgaggatagaaagcgttatacacgatgtggataacacgattacgaacctctgccgccagctctgcattggggacaagttcaaatttattatttaagatggtttccacgcaaaaggcgcccataaccgctggcagtcagctgtaatgggcgccttttcataagtttgttttattggtttttctgcttgttttattgggttttctgtttaaaaaggttttctgttttaaaaaggtcttctgttctaaaagtttttctgttctaaaaggttctctgttcttagcagatcttctgtcgacatttgtgacagtcagttcttccggatattcttattcacaaaatcatctgcaaaccggtaatacatcttttttggcatatactccgccatggccttcacaagttttccggccttatcaggtacacagacaatactgcctttttcaaactccttcatggcctcatccactacctccccaggctgacggaatccaaacatgccctttctcgtcttatccacatacattccgttattttcgtgaaaatccgtatccacaaagcccggacacacggcctgaacccggattcccgtgcccatgagctccatgtgaagcccttcagtcaatgtgacgatgaagcgttttgcagcggcataggtgacattaccgggcaccactgcaaatgccccgtccgacgaaatattgatgataatgcctttatttctctctttcattcctctcaggacataatgggtgatttctgccacagcaattgtctgaagataaataagacgcttcaatccatctatatccgtatcactaaatgaggttctgaaaccaaaacacgcattattcaccagtacatgaatctcccttccctctaatgatgcaagcagctttcttaccccgtcctcctgagcaagatctaccagtatcacaattaccttacacgcaaacttatccctgatttcctgagccctcctttcaatcacttcttttctcctgccggtcatgattaaatcatatccttttcctgcgaaccacttggcataagccagccccagaccgctggttgcccctgttatcagtgcataatgtaacatatttctgcctccttgattaagtaaacattgttcattcattatttaaaaaaagaaattcccgaaacaccggcaacgggaatccttctcttatctgccgtcctatttaccattccaagcgcgcttacgcttctaaaatacatttcataatcatgcggatgcccaacgctttctcagccgttgacaatccgtcgttctccaggacaggaactgcgccaaagagcatgtatgacgctgtcagcggtatattcccaacccttgtgattccattttcattcatctcccgcagcttttcctccatatacggttcaatggtctcacacagcttaaccgacataagcatctgaagatcgtgattctcctttttatgaaaaaaatgatgatacttttcctttccatctgtttgaataaacagctgttccattttgtccaggaaaccatccagcgaatcatccttctctttcagacgttcaatcatgggatgcgtaatatcctttacatactgctcaattgcagtatcatacagcatctgcttggactcaaaataccggtaacatagtcccggcaccacatgcatggctgccgcaatatctctcatggtagctgcctcatatcccttttccataaaaacagacatggccgtatccaatatttcctgtctgcggacctccggttccttggatattctggctgtcttgcgttccatctgtcaatctccccttttctgaacagactccttctgcttaatactctgttttcattagtcagcaggttccatacctgtttcccaacaagctggccgtctgctatatacatagaatatcactctattgaacaaaagtcaatgaattatattcattcatctgaacgaatacccagaaattattactttttttgttctatttttattccatctttaagattctatttccatttcatgaatatcgccatattccattttttatatgatatactctgtttatgaaacatacatatcctgattgcattgatatgataccataatttcaaggaggttgcgatggattatctgggtctgattcctttatttgttttaggtctggccatgattataaagccggaatatctctgggaggttgaacatattttcgcagtggacggcgtagggccaaccggtctttatttgacatttatccgggtcagcgggacattttttatgatatgttccgtggctgccgcactctatgtattgcttccgtagaggcgggatatatggtttgtgttaataactcctgcagacgttgaatcaggcgtgaaagtttcctttcacgcctgcagtttcaaatcaaaaagtaagctccggtgcaatccgcttctcaaacccaaaacgcattgtcatatatgtatctaccatctggcacacttccacatcccccagctcagcaagcatcagcatcagatgattaggggtgtacctgtcggtccgtttcagtataaattcctgtatacactggactgccttgaaacccgcttcctccagagtatcgtccgaaacaatcgcataccaacggtcattcgtttcaagaatcggccaaggttctgtaattcctttgatgacttccagtttaaggtcaacctctcccgcaacctccagaccgcctacgatttccccatcgccctggtacgcatggatatctcctgtagcaaccagtcctcccggcgcaaacaccggcagatataggatgctcccctttgtcaaatatttacaatccatatttccgccatggcgtccctggtcaagagtactcatacgctccgcggcagctactcccagacatccagggaatggctttaaatcaactttcacgccaaacatatctgcttgcccatctttgattgggaatttaactacctcatcgtccgttatatactttctgaatgccttgcatacctgaatatcattgcaaattaaggttgcatccgatgtaacacgtacatcttcaattgtaattttcattgtatcaccaggcatggcaccatttacataaactggtccattcacaggattaatagggtatccgtgcatagcccttgcctgaatggtatttgtgtctaccattacatcgttccatgtatcctgacatgtaaaactaacagtttctccagaatccacctttgccactggaacattccatggactataccaatgtgtgtgctttgtaggatctactttaatcatggttctttctccttctctcctcgtctattcaatcaccatagctgtctcacttaggatgtcataaacatcgtcaatattgtcttttgtgacaagtaatgtctctatctcctgtaactgctcaacctccttgccatcaagatggtcaatcactccatccaacgccctggctcccattaacagcggttgctgtgtactggttcccacgatagttccctccctgacagctgccagcaattcttcattgctgtcaaaaccaaatatcatgacctcatttcggcccgccccctggcatgctgccagtactccaagcgacgcgtcgtcagatgtgcagaaaattgccttcaggtcaggatatgctgtcagataatcctgagcataggattctccctcactgcggttctcgcgctccatctggcggaaatcaacaatctctacattagctgtgccaacacccttttcaaaccctgcttttctgtcctgctgattctgacgtgcctggggtcctacaatttcagcaaccttatcgccttctttgagaagagatgccagatacttgccgccttcctctgctcctttcaggttatttgttttgataaatgtcacatattcaccggaatctgttccaatatcactgattgccaccggtatccctgcctcttcagccaatccaagtactgccacacaagaagccgaatctgtcgggctaatcacaatgccatctacgccttttacaattacatcctgagcatttgtatactggatatccgcactattcttactatcatacgtcgtaaccgtaacatttcccagtttctcagcctctctctcaacacctgttgccatataacgccagaaaggcgtatccatagacggacacagatacgctatatggtagctctcccctgacttttctgcctcattttctgcttctgccgccttctgtgtttccgccgaatccgctgtcgtgtcagcagttgttgttgcctccaccgttgtttcctttgcctctgtcaccgccgcagtagtgctgtctgccgttttacctccgcccgtacatcctgacaggctgaccgccatcattgctgccataaacattgccgctgctttcctcattttcatttcctcctgtacttttattttaatatttactatttagttatcttttttcttgtgtgacaactgttccgccaaaactgccaggatgattacaacaccgattgctgttccctgccagaaggtatttacccccagaaggttcaatgaatttctgagaacgcccacaataaaaacaccgattgcagttccccatagcgttccctttcctcctgacataaaagtaccaccaataacgaccgctgctatcacatccatctcggcacttttaccgtaagtcggatcacaggccattaaccgtgatatcataacaagacctgccgttgccgcagtcaacgctgatatgatatatgtaaccattatcacttttttcgtcttaatgcccgatatcctggccgccacttcattggaacctgtggcatacagaaaccgcccataacgcatcttagtcagaacagccataaatataacgtacagcgcaataatcattactagataaaacggaattattccaatcagtttacctttaccaataaatccgaaaacttccggaaacttggacgcagaggagccgtctgttaccacatagttcatgctctggcaaatctgctgtgttcccagagtaacaatgaatgcaggaagcttcatgtatccaatcaaaaaaccattgataatgccaataaacagggcaataccatatgccgtcaatatggcctgaagtatatttccggtggcctgcagtctcatagctgccaacatgcctgaaaaaccaagcaaagtacctaccgaaagatcgatgccgcctgtaatgataaccaatgtcataccaattgccataagagccgtagtggattgctgggaacaaatattcaggatatttcctactgacaaaaacgtggatgaaaccatggacatgacgacacagccaaccagcagtactgccaacataatcaattctgtcctgttattgcgcagcgcccactggcgcctcatcttcttatattccccgctccaggaaatctgtttcacatttgtatctttatccatttactcatcccctcctgtctctcccatagtagcgtagtaaccgatctgttcttcagtggtttccgaggtcttaagcctgccaacaatctttccatcccgtacaaccagcgtcctgtccgtaactcccagaatctcatttatttctgatgatatcatgataatggaaaaccctttgttcgccagttcccgcaagattgcataaatctcacttttagaggcaacatcaattcccctggtgggctcgtctattatcagcaattccggctttgaaaggagccatttccccaaaagaatcttttgctgattccccccggacaggctgctcactttgttaaagggctctcctacttttatgttcagacgttcgaccatttccctgcaattatcttcttcaagacgattgctgataaacggtctattcgctatggcatgaatcaccatattcagattatgcatgatggatatatcctgatggagtccttcctccttccgtttttccgaaaggaaacacatccccgcctttatgctggcagttatcgaatctttcctaacttcctttcctttaaaaatcacctttccttcagaacgcgaatcaattccaaacacacagcgcataagttcacttcttcccgcccccactaatcctgctatcccaaggatttcgcctttatgtacctgaaacgaacagtctgtaacaaaattccgtgtatcacttatatgctgcacatcaagtatgatttcatcagatatcatctcgtctctctgagcggccttgccgtataaatcatcaatctgccgcccaaccatagccttaataagctccatctcctcaagttcactggtatccgcccctgaaagtaccagccttccatcccgaaatacagtaatccggtctgaaatttcgtatatttcattaattcgatgggaaactatgataaatcctacacctttttctttcaattccctaatcatgtcaaaaaggcggtccacttccctggctgataaagtagccgttggttcatccagaataatcaccttagcttccttggacattgccttgataatttccactatctgcatctccgcaacagatagttttgacatcttatccatgggatctatgaattccctcatatgaaaatatctcagaagctcatccgtcttcctgaccatagcctcataatcagctatccatccttttttgtaaaatgattcatctgtaagaaaaatattttcagccacactcaaatgcggtattgtattaaactcctgcagcacaatcgcaatcccatcattcagagcatccttgggattggcgtaagccaccttccttccctggtaatacacatccccttcatctgatttataaatccccgttatacactttcccaaggtggattttcccgcaccattttcccccatcagtgcatgcacctctcccggaagcagttcaaaggaaaccttctgcagtgcttgtgtggaataaaatgccttagaaatagcaaccgccctcagcaccggctcacaaatccgttcatccatcggcagtctcccccctttctttctcatggctgaatctcattcctcttctgacgattttatagtgacatttgaaatcttttcataatacttcacaatgcaggaatggtcctttttttccagcccatcagctttcagagcctgcataatttccattaactgcccggtcatcaaaaccggtgaactgaccgcatgggctgcattaatcgcattccccaggtcctttatatgcagttcaatacgaaaacccggcttgaaatctccccgaaacatcattggtgcttttgcatccagcacagtggacccggctaatcctcccctgattgcctgatataccagttccgggtccgttcccgcctttttagcaaaggttaatgcctccgagaccgccgcgatatttactgccacaataatctgattggccagctttgccacattaccagctcccaatttacccacataaactacagagcctgccataaccatcaacatgtcataatatctgtcaaacagttccctccttcctccgaccatgacagacaatgtgccttcaattgctttgggctcaccacctgataccggggcatccatcatttcaattccatattttttcagctccatgccaatgcttctgctctccgtagggtcaatggaactcatgtcaatcagcaccgttccttcagaagcaccttctgccatgccatccttccccaacaccacttccctgacctgtggcgaattgggaaccatggtaatcactacctctgcctccaatgatgcttctctgctgctgtctgctgcccttgctccgcatgataccaaatcagccacagcctcttcattcaaatcatataccgtcaaatcataccctgcttttaccaggttcttagccataggcctgcccatgatacccaaaccaataaatccaattttcatgaaaatccgactcctttcaaatgttcgcaatgcttctgactgcctctgccaccgattccgctgtcagtccataatattccagcagctccctgtaggagtgcgaactgcagccaaatacatccttaatgcctacaaattccatagggatcggcttccttctcagtatttcggcaaccgcacttcccaggccgcctttcacagtatgctcttcagccgtcacaatccccctgcatcccttaagcaggctgatgagtacctcctcgtcaattggtttaacagtaggaacatttatgaccctcacacttatttcatctttcaggatttctgcggcttcaagtgcttcctttaacatatatccggtggcacatactgctatttcttccccttccttcatcacatatggtacacctatctgaaattttcttccctccggtgttacattatcatattcgttcctattcagtctgagataacacggaccctcatagcctgcaatcgccttaaccgcttcaaccgtttcatttgcatcagccgggcagaccactgtcatattaggtatagacctaaatatggccatatcttccacacactgatgtgtagcaccatccccaaaatccgagaggccggaagaagcgccgcatattttcacattcagtttgccaattgcaatagtctgccgtatctggtcaaaagcccttcctccggcaaaaacagcaaacgagttggtaaatggtatctttccggtctgggccagtccggctgccacactggtcatatttgcctctgctattcccatttcaaagtgccgttcaggatatgccgcctcaaatatcttccccatagtcgagccacccaaatctgcatccagaaccacaatccgctcatcatctttccctaacatctttaaagtattaccataagccactctttgatttgtttcacccatttcagccctccccatctacacagccaactcggcaagcgcctgtcggtatgtctcatctgtcagcttaccattatgataagaaaccacattttctgcaaagctgagaccttttcctttcactgtgtctgcaacaatgaccgttggtacccctttcacctgatctgccccatccagagctgtcagtatttcttccatgttgtgaccgtctatctctatgacatgccagccaaagcttaagaatttagcggcaatattaccggaatccatcctttcttttatctttccatttgcctgaagcccattccggtccacaattgccaccaaattatccgccttaaaagcgctggctgccatgacagcctcccagatctgtccttctgctatctctccatcccctactagtacatatgtttttctgtccagtccatccaatctttgtcccagagccatacccagtcctatggaaaggccttgtcccagagaccccgtaccagcctctataccaggtgtcttaagtacgtccggatgtccctggagataggagcccagttccttggtatggggcaaatcttctaccggaaaataaccagcttctgccaacgctgcatattgcaggattgctacatgacctttgcttaacaaaaaacggtccctgtcccttttgcggggattcttcgggtcatgtctcatcttatagaaatagagagccgtcacaatatcagcagaagagttagaaccgcctatatggcccgctactcctatccccacactgattatcacatcccgccgcaggatctgcgcctttttttctagattatcaatcaattccttactatacactactgtctcctcctttcgctcttgcatccatatgtttcaaaaactccagtgtcacaggggcctctgccttaaaatcaccagaatatgcctcgcagcttatcctgccgtcatatccaatccgattcagttcattaaaaaattcatgataggcctcctcatcctgatatccgggaaattttctctctgagctggaaaaatgaacatgtgccagatatcttccgccaggtccacttaaatggctcatgggttccgcctcagccatcatgtgaaaataatcagctaatacctttatgttaggatgtcttaattcatccgccagcctccccccctcctcaaaggtattaataagattacattcctgttttctcagcggttcaatgcatatgataatgtctctgttcgcggcaagagacgctatttgattcagcagatccacaatctgctgatatcccttttccagcgaagtccccttcggaacatttttagcagagccacttccaaacaccacacatgtggcacctaaatctttagcacgcgtcagggcccgttcagcatagctcaataccaaatccatacgaacctcttgtcctgttagtctcatgtgttttggaaaaaagttgttgcagacctcacagccgatagtcaaccggtccacccttctctttaattccaaaaaattcggcccatcaagtctcatcatttccgccagaggcatttcaacatagtcatatcccatatgctctaattcactcaaatgttctgttccaattccatcaagttctgaagcaaccatattgatgcaacatccaaacctcatacttctcctttctgtattaaaaataaaagcaccccctactaacatgttagttttgttttatttctattttctatttttaactaacatgttagttgtctatgtttagatagtaccacccatttcttttattgtcaatatatctaatatactttgtatattctttttatttctatctcttttatccaatttatttcaacccccgccatatctatgctaaaattctattgttttattttactacatgtgctaaacttatattgcataagtaaaatgtcacatactataaaaagaaggtacattaatgggaaaatatcagaaaagttacgaagactccatcacaaacgagcctgccctgaataaacgagcctataacatcatcaaaaacaggattatatttgataaactacaccctggtcagcagcttagtatcgccagtcttgccgaagaactgcaggtaagccgtactcctatctctgtctctctttctgctcttgagagagatggttatgttgtggtacaaccgcaacggggaacatttgtcagggagctcactccctttgaactggaaatcatttttaaagccagagcatctcttgggaaacttgttatagaaagtgcaggacatttaattagcaaggaagaactcaacaaatttcatgaggagttcagccgtttccgaaacatgaagtacataagtaatcctgatttgatagaactattttatctggatgtggaattccaccggctgcttgatgagtgtattccaggaatcattcacgatcaggttaaagtaattgccgatttaaccatgaacagccgttatattgcttaccgcaatcgttttggcggccttacagaccaacaaatcaaggttctgtgctgcgataatcatgttgctataattgatgcgcttttaaaaagcgatgtatctaaaggagccgatgcttttgtcaaagatgtatgttctggctgggaaagtataaaattataactatatgcattccccaggcggatttgtttactgtacaaaaaaagcatccatgaagcgctttttccaccgcttcatggatgtttgtaccttatattgaaacttgaaacaatctacacactaagtgtcactcttaaaatgattactattatcctcgtacactccacaccttttccctaaccctattctttaaaataccgcctgcactgctgcaaaataaaccccattattgcctgagtaaatttttcacacaaagttcaaaattccctccccaggcttcatgttataataggcttattccaatgaaccacaggagggattccatgcgcatattagtgattgaagatgagaaacggctggcatttactctggctgacatgataggcggggcaggatattatacagatgtctcccatgacggggcagagggactggagcttgcacaaaccggcatttacgatgccattgtcctggatgtgatgcttcccggaatggatggatatggggttctgaaaaacttaagaagcacccgcaacatgacgccggtgctcatgctgactgccaggtcggagctttcggaccgggtgaggggattagatgccggagccgactactatctgacaaagccatttgccaccgaagaattcctggcctgtctgcgcactgtgctaaggcgccacggagatattgcgcccgacactctgacctttggcgaccttatcctcacaccctccatgcctgaacttatctgcggtgaaaacagtgtgtctttaagcgccaaggaactggaactaatgagcatgctgatacaaaacagcagtcagtatctccccaaagaaaccatactccttaaggtctggggatatgacgccaatgtgaattccaacagtgtggaggcctacatatcatttctgcgcaagaaactctcgctgctgggatcctgtgtttctatctccgtcatgagaaacattggatataagctgggggtgtccctatgatacgaaaactcagatggaaattttcagccatcatgatgaccattgtcgcttttctgctggctgtcattttcataacgctgtactacacaacaaaagcaaactacgttcagcggagcatgggcaccctgcattccgccatgctggaaaattatccgggcagtatgcgggaacaggcagggcagccgccctctgcgggccagcgtcctccctcccgcccccgcaggcaggaacttcctctgatggtggttgatataaggcagggcaactatactgtagtaaagaaccagcttccagatatagaaagccaggaggccgaaaccctgatatccctggcggaaagcaagggcggtgagtccggtaccttaaaagacctgcacctgcgttttctccggggaaaaaccaagcctgaccaaacagtgcggtatgtattcgccgatatatatgaggaacagaattcactctattggcaggtgattcactcttccattatcggagcaagttcgtttgctgtctttttcctgttctccatccttctctccggatgggctgtgaaaccagtggagattgcctggcagcggcagcgccagtttgttgcggacgcctcccacgaattaaaaacacctctcaccgtcatcctctccaatgccgatatgcttgaaaaagaccgcgatataccgaagggacaaaaccggcagcggataagccatataaaggctgagtccctgcggatgaaacagctgacagaaagccttctcgccctggcccggagtgactcaggacaggagtctgcggtctgcgcaccagttgacctgagctttattgtaaacagcagtcttatggcctttgagcctctggcttttgacatgggtaaacacatcacctatgatatcgaagctgcacttcatgtaaatggagatgataaaaaactccggcagctgacagacattctccttgacaatgcctgcaaatacagtcaggataacggctccatctgtgttaccctgaaaaagaccagcgcaaaagaggcgctcctcactgtctcagatgagggggcgcctctcacgaaagaagaaatcaaacacctgtttctccgcttttaccgcggagacactgcccgcagcaatatccccggctacggcctcggactttccattgcccaaagcattgtatctgagcatggaggaaagattgaggccagcacggatggtttcgcaacaaactcatttatagttcggctgcccatacaggaataagaaagtattcccggccacccggcatgcttcaaggcttcggcttactccatgctaccgctgcttcccagaacatggataccttccggcaagctctcttccggcgaattccccgccagcaaagtctcctgtattacaacaacggaggctttgccggaaacatttccggctccttcggattctgattcactgccaatattatctgcgtttcccgcttccggctgcattttccgccttccctcccggcttcctccagcattctctccttctctaccttcctgtgttcttccgaagttttcctctccggttcctgctcccggcctttcttttaactttccttctccgccgcctgggattcttctaaaacctccgctggaaggcgtgccatactgattcaggatgccgtccaccgtcatctgaatatcctgttctccggcctctatgtaataagtctcccctgattttaattctggcgagctgaaaagcagagcctcaaagggctttgaaatctctgtttccgtcaattgatttcccagcccgtcctttattgatatggttgttccggcatcctgcatttcatcaaagtaaaccatcagcatgggctgggatgaactctcagaaaacgtctggaacattcccgcacttcccacagccaatatggttcctcctgaaatggttcccgtaccattgtaatccaaagcaccatttcccccttctgccgggccttctgcgacgacggtacctccctccagatacaggtctccattggagtctataccatccccggaagcattgatcttcacgtttcctcccgtaatacggatgtaagccccttctgttgcaccaaaagaaccgccggctgcatttggatcgccggatgtatctgcaccccgggctgcattaattccatcatcctctgagttaatctgaatggttcctccagtgatttccacacagagcccttccagtccctcgcggctttgttccacgattatggttccgcctgagacttccaccagattatcactgtgaactgcatcgtcgcctgcggacagcgtcagctcacttgagaacaaccttacattcttgccgctgtgtataccgtcatcctgagcatttatgtcaatgatgccgcctgtaacctcaaccagcgtttcggccagtattcctttctttcctgctgtgatggccgtggttcctccggtgattctcacatatcccttgtcttcttccccattattatttgactgtatcccgtcgctgcctgctgtaatggtaatctctccgccgttcacctctacggcgtcctttcctttcacgccatcttccgccgcctcaatgacataggtaccggaattaatggtaaggcgatcctttccccgtataccattcatataattaccgctgactgtcagcatgccgttcccctcaaataccacatcatccttgctgaaaatggctgcatccggctcatcctcccctgtctgcggataagtatatgtatttccgtcagataccctgttttctgtcctatcctccaggacaatggtcagaagtccgctttggctggcatagattgcggaataatccgcacttgtaatggaaacgccgtccagtatcagacatacctcatcctcctttcccgcgtccaccaccacgcctccccctgtaatgtttcctgtcaggcggtatgttccggaagatgaaatagtgacattggctccgtcagccgcagcccctgtcccttcaatggccactgttgttccatttccagtgattcgtgtttcctctccatcaccaaaggaactgtctgcatctgtccggtttgtgtcctgcgtccctgccgcctcctggatgcctgctgtttccgatgttccagcggctcccgccttactcccattctgcccggctgtctttgtgcatccggcaagaaacagaacaccggccagtccggccgctattccaaatatcttaagtttcctgtatttcagtccatttctgcccatatgattatcctcctataattcatccctgccatccggcagccggccgcagacaatggtaaggttcccatttctgcaccgtatttcatccagcatgttcttttcaataaattccgactttaaatccacctggtagcacagttcatagagactgcccatattcacggtcctgacccgcacaagctctgactttttagtatacttcgcaaatatatcgtcaaaaatccctgaatagtccagattttccggtatcgtaattttcaattcctttctcccggccctgcctgccggaagggatatcaaaaggatggtaattccgccagacacaatcatcagaagcatagcggttcccagataccccattccagcggccagacccagagccatggccaggaatatacttccaatctctcttgcattgccgggcaaggacctgaaccgcaccagactgaacgctcccatgaccgccactccggtacccaggtttccgtttaccagcatgatcacggtctggaccataacaggcagcaggaccagagtaagaataaagcttctggaatactggttcctgtatgtatgaaccacagccagcactgcccccagcattactgatgtaatggtacagagtaaaaattgtcccattgtaataccggtatttacagtttctgtcaacacactctcaagcacagattctacctccctctataaatatcccttgatacaggtactctttataataggcaccatattttgaataagacaccggaaaaagccccatatcggaaaaaagcctgctcatccataacggcatcgccccaggaattttcacctccatcagaatttggtccttatccaaaagcattgttccataaactccattcttcagatccagtccgctgcacctgcagcaaatattccggtcaaaggtaattcttaattcttcattgccctttccgtaatatgccgcccggtcataggccacaaaagccgcgggttttaagtcataccgattcaaaacataatctatttccttcaatatctggctctcctcaatccgccggattccataatacagatactttctcgcctggcagagaggcactggtatccggcgtttgtacaccaccccgtcaaactttttctttaattccgcatataccacgctggtgtccgtcgccttcccatatgccctcaaacgcagcttttctttatattccggtttttcaatggattgtctgaccagctggaaatccggtgtatcaaagtaaatattggatatggtatattccccataatggtctgtatccatctgtctttccagagcaggcatcaaagcatcatactgtttttgggtgagcatatattttttctcgtagcgtttgaatatttcctgagtcatacacatggcctccttcatcttttatggcttttatcctaacagcccaagctgaaacaaaccttaaaaaaatcctggaaaccatgagctttctgtgaacggtcgggggattttctgtgaactgacaggggattttccggagatttctatcaattaccgaaatatctcaataaaccatcaagtttgcataagactatccccgattacaaaccaagcaaatatcttttaaaatacgggcgccgctgttgtggaagtcaaaaaacgccgccgggactccatccattcccggcggctttcctctcaccatctgcttacagactccagttcaggctcttaccctgaagttctgccatgtgatggtatatccctttcttctccaacagttcctccggcgtaccctgctccgccacataaccatcctttagcaccacaatccggtctgcgcctgccacagtcctcatccggtgcgcaataatcagcacagtcttattcttgaccagattggatatggcctgctgtaccagagtctcattttccacatccagagacgccgtggcctcatccatgagaatcacgggggcattctttaaaagggccctggcaatggacagccgctgccgttccccgccggataaggcagaaccattttccccaatccgggtctcatatccgtttggaagacgatgaataaattcctcacactgggctgccctggccgcttccatcacctcctggtcagatgcgtctttgcgtcccagacggatgttctccatgatggtattgttaaacaggaccacatcctggaatacaatggaaaagcttctaagcagggtctccggctctatcccgctgatatccgtacctcccagcgtaatctttcctctgtcaatatcccagaacctggcagccagctttgcactggtagattttccgcctcccgacggccctaccagggctgtcacctgtccctgtcttgctgtaaatgacacatcctttaaaacctgtttcccatctttataggaaaatcccacatggtcaaatacaatgtcatatccatcgtacgcagcttccctgcttccatgctgaacaggctgctcctcaatccccttcatccgttccaccaccagtaaagcagagtacacagccgacaggttctgcagacagccggtaagaggtccgtacagcctggtggacgccaccataaacatgaggaacatcataaagccgatggaatgggatgacagaagagcagctcccgccagtaccgtggtagccatgccgactttcaggaacatctgggacgctgtgaccatggtaccgtttaacagttccagacgtatggtgatggattccacgttcagaatcttctggtccagccccctcagatactcctcctgctggttgttggccctgatgtcctggatattctcaatgcactcctggattccgtccgaagcagcgattttctttcccttctgcctgcgctccacctggtccaccatgggtcttgtacctgctgccagaagaaaggatatgggaaccacccacagcacagccagccccatccgccagtcagccgccataagacacactcctatgatcgccgtggataggaaggcccctatgagttcaggaataaaatgggaaaatgccttttcaataaacgcgctgtccgccataatggtggtggtcaaatccgccagatcccgttttccaaaaaaagacatgggcagggttctgagcctctccgccagacgaatacgcatattggcgctttccgtataggatgccacaaaggtagcgtcatactgtattctccagaaaatgaatattataaccagcagtacaatgcaggctgccacatacccggccattcccagggaaggagcctgaatccccaccaacgggcccagaagccgttccataaagaggaacaggatgcccatggggaatatcagccccatattggtgagagcacaggaaaatatggcctttgtcagatcccttcctccctgttcgctcaaggcgaattttttctgcagatacttgctcatgcctttccacctaccttccactctgctgatgtctgataatccttccacatttttgcatacagccccctggccttcaaaagttcatcatggcttccctgttcagccacacggcctttctccatcacgaagatacggtgagcccggcacaccgtagacagcctgtgggcgatcattatcacggtcttgccctccaccagcttctcaaaggccagctgaatcagatattcattgtcagggtcggcaaatgccgtggcctcgtccaggagcacaatgggagcgtcctttaagattgctctggccagtgcaattctctgcatttcaccgcccgacaggtacacccctttggttccaaccaccgtatccagaccctggggcatcttcttaataatgtcctcacatctggctgccttcacggcccccatgacttcctccttatctgcctccggttttgccgcccgtatgttgttcatcagactgtccttaaatagatggctgtcctggaatacaaagctgaccctcttcatcagttcttttgtctccatctccctcacatccacaccgccgatacaaatgcttccctggtccacatcaaaaaaccttggaatcaggctgaccagagtagtcttgccgcttccggaagcccctacaatagctgtggtggctccctgcggcacagtaagagacacatgctccagagcgtttacaccgtccttgttataggaaaacgagacgtccttaatctcaatcctgtgattttcaggcttcctgggagctgcgggctcagaaagaggcttctctctgataacattcaatattcgctccagcgcgtcattggcagccatggtattttcactggtccacatgattttgtccatcatagtcacgcagacaggtgtaaacaggatatagaaaaccagatccagggccatggtcacaaaaccctgcccgcccgccgcatcccctgccagaagaaggcccgcaggtatgagaacggcaaatatgctgttgatgctgaccgaataacagcacatgggaattctgagggacagggtataattcacagcccagttcttatagcgaatgatggaatcatgaaagctcttaaaggaaaaaatgctctgctggaatgtctttaccacagggattccgcgcacatactccacggcctcgctgttcatgtcctccagggcattctggtactgcttcatgcactctgccattcccgtccccatcatcctgctgaggaaaaatgtacccaccgccatgggaatgaggctgataaggccaaatctccagtcaaacaccagaagaagtaccagcactgccgccggcgtcaccaatgctcccgccaaatccggtaactgatgggccagataagtctctgtctgtcctgccccgtcgtcaatgatacggcgcagttttccgcttccggtccccctcaaatagccaatgggcagctctgccaggtggtgaagggcagccgtcttcatatttctggctgtccggaaggccgaaagatgggtacacataagagccccaaaataaataagcatgctcaggagtgaggaagccaccgccatccacccccagtaaaccagcgttccgccggccagtcctcccggccagttcaggaccgccagctttatcaccttccacatgcacagatacggcaccagcgctataaccgcgctgatacctgacagaatgcatcctgtcactgtaaggtatttatacttccctgcaaaggtcatcagagtcaccttacctgtatcgggaagccgtgtcataatatgtttcctgctgccatccactttttcatcctccttttttgttagttataactaactcattgttttaaaaataaggctgtcaggcttctgccttccggctttccgccctcaagccccatctcttactcacccaactccatgattcgcacccagcccgcatgctgaaaacggcttaatgtgacagcacaggtaattgcctgttctctcggcaggtcgtgggacacaaattcatggagctgctggaaaaaggacctgcacagaatatgaatcagtgtgttgctcattccttcagccgaatgccccaaagattccatagcttttataaaatcccggcaggactgctcctccaccgcggccagcctgtcaaaataacggtccctggcttcctgggcgccgcagcacagaagcagcttgaacacctcaaaatgatcatagatataattcaccatccagggtatgtactgctctgtaatctcattcagcctggctggctgctgttcaggcggcagcgcagcaaagtccctgtgctctttacggtacagatccagcagttcctccgccgtatctgaggtcagcgcgtcaaacaatgctttcttccccggaaaataaccgtatatggctccggttgtcaccgatgcctcctttgcgattctcctgagcgacgctttctcatatccatatgtgagaaattccttctttcctgcctccaatatggcagtaaccgtaccgttgtacctgtcctccatgacaatcactccaaccttttcccatatcattataacactgttatataacatggttattatggtacaaaaaaaggcatccgtcaatacatataaccgataccttttctcattaaaccattttatctgttttttgaaaaaacttctcaaaaccaatgaatgcagcgtactttctcagcccttcatccaccatctgtccaggacctgccatattgtagagggcggcttataagagccccaccagctccaggctcggttttaaagtatctgctcccggctgccattttgccgggcatacctgatcaccgtgctccgccacaaactgggatgcctgaacacgtctgaacagctcgtccgcattcctgcccacatttcccgcgattacctcgcaggcaacaatctttccttccggattcacgataaagcttcctctttcagccattccgtcagcctctatcatcacatcgaaatccctggccagactgcccgtgggatccgccagcatgggatacttgattttctgtatggtccttgatgcgtcatgccatgccttgtggacaaaatggctgtcgcaggatacgctgtatatctcgcagccgactgacttgaagtcctcatacttatccgccaggtcctccagctcagtggggcaaacaaatgtaaaatccgcgggataaaagaaaaatacagcccacttccctaaaacatctgatttcttcacttccctgaacgctccgcctgcataggcctgtactgtaaaatcgctgatttcttttcctattaatgacatattgtttcctcctggtttttgtgatggtttactgctgccttgccttctatcccgttacccttgaaacagaaatccattgcctgctgcccggttgttagttttgtctaatttactcatattttaccagaactaatcccttttgtcaataaataatattgataattattattaatattgtttatttcgaaaaacataaaaaaacagccagacaagtttccccatctggctgttcccatgctgcgttattactcctcaaacgaattaatgacggataattccggcttcatatcatacttcttcttaaatactatggctcccacgattccagccagggtaccgctgatggcagccagcagcagcgccataagtacctttaacggcggattgaaggcaaagggcgccagcagtccgggtatgggagaagcggttcccggggcattgttgataatgcccaggaatgcggcggccactcccgaaaagcctcccccgaaaaagttggaacaataaatcggtatggggtgctttgttatgatatgagcctgtgtcagcggctccatcataacagctgccacgttgctgttatccccgaagtggagcattttaaagatgacaccattggtaaaggaaccgccgaagcaggcaatagctgcaatacccatgggcagtcctgtaagtcccagcatggcggtaagagccatggaactgaggggagacgtacaaatcatcttgataacccctcccagcagaagtcccatgagaatgggcgactgctctgtagctgccgaaatcatgccgccgatgtgcgccagggctgcattcacagccggatccaccaggaaggcgatgaatctggcaatcggtgcaatcatgagagcacccagcacggaatccaggcccggcggaaggtgtttctcaataaacggcgcaatgaagccaattgcatatcctgcgataaatcccggaaggatgccgtatcctcccagagcaacaccggcaactactgcaaatacgggattcactcccatgcctatcggtaccataattgccgctgccacgccgcccatgttgcccgatatggtgcccgtttccccaaggaatgccaggtgaagcaaatctccggatatgtacctgtggacagcctccacaaggaaagttgcaactgctgcattggccattcccgacatggccgctgaacctttgggcgccttcatactgaaaagtgagaaagctgccagcgtcaataatagtaatcctaaccccgtaataattgtcataaatctacgttcctcctgttttttgctctccgcagatatgcttggccgctttccaccacagaccgccgttaccgctgtgatagctcttaagctaaggtatatccttggtagagttttcgcaatgcaggtaacgaagaagtccccaaaattgcaaaaaaacagagacagacataaacgtagcgtagatgtctgcctctgtccttttacctgaaagtttccctgacgcggttgctgctatgccgccggttgcttcatcggtattcacattttagtgaccttctccagagtcccgtccgaattcgattcttttgcctgagagtttgcgcatccccttcggcgttacctggcggtaatctctcccgaattcatcaaccggtctgtcattaactttgtttatattttaacatcaaacatagaaaaaagcaatagaattatgttcagtttatttctttttcacaaaaaacataccgtttttttatgcatacggcacaatttttttcacaataaatgacagaaaataaacatatgtccatttactctcttccattcccaaaataattgtaaaatacaggaagggggattttattttttctgtacgcgccttcaaaaatcaatccagaagattggtcatgctctttaaactgatagccagagtggatgtattgtggagcatagctgatgcggccggggttatgacgcctcccactcccagaagaataagacccaggttgaatccgataacaaaccggtagttccggtcaatccggtccatgagtgcccggctgatagccctcagtgtcaccagttggaacaggttgtcctccgagatggtgatatctgctatctccctggcaatctcagccccttcgctgatggcaattcccgcgtcagcagccgacagggccggcgaatcattgattccgtcgccaatcataataaccttgcggccctttttcttttcttcgtccacgaaccgggccttgtcctcgggaaggacctccgaataatactcgtccactcccacccgtccggcaatagcagcggccgtgcgctcactgtctcctgtcatcatgacaatcttggtgattccctgcctgtgaagggccgcgatgaccgcatccgcctcatccctcagagggtcctcaatgcagataacggctgccaggcttcctccgatggccaggtagaggtgggaatattccacgggaaggctgtcaaataccgttctcttatcctccggtatcctgcatccctcatcttcaaacacaaagtgatagcttccaatcaccaccctttcatctcccacataggtggcaatgccgtgtgctacaatataatccaccctggaatgcatctccttgtggaccagcccccgcttcactgcctcatttaccacagccttagccatggagtgggggaaatgctcctccaggcaggcagcaatgcgcagcagctcttcctttcccatgtcattgaataccaccacatccgccacctggggcctggcctttgtcagggttcctgtcttgtcaaagataatggtgtcggcagcagccactgcctccatatacctgcctccttttaccgtaatatggcagctgccggcctcgcgcatggccgagagcacagacaggggcatagccagcttcagcgcgcaggaaaaatccaccatcaggatggacagggcctttgtcacattgcgggtcagcagccacgtaaggatggttccgcccagactccagggaaccaacgcgtccgccagggtggctgcctttccctcagccgtggacttaagctgctccgactcctcaatcatggtcacaatccgttcaaacctggtgtcgcccgcagccgttctcacccgcatggtaatctctccctcctctacggctgttcccgcatacacgtaggagccctcctccttcctgacaggcgctgattcccccgtcatggaagcctggttcaccatggcgtccccggaagcgaccactccgtccagaggaatcacatttcccatatggaccgttaccaggtctccctccctgatttttgaaacaggaaccaggacctctgtcccatccacattctgccataccccggcaatgtttaaggacatgctcctggcaaggtcgcccactgactttttgcgggtccattcttccagaagttccccaatccccagaaggaacataacagaacccgccgtgtcgaaatcccgtctcaggacagacacggcaatcgctgcggcatccaaaacctccacctccagcttgcccctgagcagacagcggactccctttagcaggtacctgacggagtgggcggccgtatagacggctctgacagaagccggcagaaaggatttggcaaatgccctgaccaccactttccggaccagcttctccttgtattcgcggttcagggcccttccgctgttcttcggcaccagctcttccatccgctcactatcataagaaaacctctgtattccctccagtatgcacctgcggctgccttcatacaccacagcggcatccgctgttctctcatataccctgacattttttactccgggaagggtgcagagataataatgcagcaaatcagcctgccgtatgctcatatccttctgataaatatgaaccctgacccttccccttatctcatgtctaattacaaacttcattgtttcaagctcctattctcaactgtcctggacacattttcagagtaaatgaaaaaattaccgcccggagatttcttccccaggcggattatacattacgctgtaaccgtatcagcagaagctgtctcatcttccttcaaatattctgaggtatgctcaggggcctcctccctgctttcatcctcaaatacctcctgacagcgctgtgcattgatttccctggcctctgccagaatatcctcagcgttctcctggatattggaggcggtggtcatcacacagtctttagcccttaatccggcagccaggcagttgatatataactttttggcatcatcgcttcccagaatcttcacacctgctgttccaaacaggacgccgcctaaaaaaaggcccatttttttacatttaaaacaatcgatcattcctttatcctcctaattatatgtaaacaatccttatcaggcacaaaagagtatgcagggctgttatgatgctgtcttggcctttacattcacattaagagaactgccctctttataaggccttactaacagatagatgaatacggccacggccccaattgccgcaacggttccgactccaaaggttccttctgtaaaccatctgccaaactggtatatgcacagtgccaccacatatgcaagtatggtctgataaccgattgcaaaccaggtccaccttgcattgttcatctcacgcttgatggcgcctatggcagcaaaacagggggcgcacagcagattgaacaccaggaaggaatatgcgctgacggctgtaaagctctgggccagtgttccccagatttctgatccgtcctcagccacttccgcaaaaccatagagaatgccgaaggtgccaactacgttttcctttgcaaccaggcccgtgatggccgccacagctgcctgccagttcccccatcccagaggagcgaatatccaggcaatggcctgaccgattgacgccagaattccatccgacaaatcttccaccataccaaaatgtccgtccacaaacccaaagctggatgtaaaccaaataaaaatagtggacagcaggattacggttcctgccttcttgataaaggaccagcctctctcccacatgctgcgcagaacattcgacacagttggaaggtggtaagcaggaagctccattacaaacggcgccggatcccctgcaaacatttttgttttctttaagatgatgccggagcagataatggctgcaattcctacgaagtaggcgctgggtgctacccaggaagcgcctccgaacagggctcccgcaaacagtgcaataataggaagctttgctccgcatggaataaaggtggtggtcatgatggtcattttgcggtccctgtcattctcaatggtacgggaagccatgatgccgggaacaccgcagccggttccaatcagcatgggaataaaggactttcctgacaatccgaatttccggaaaattctgtccatgataaacgccaccctggccatgtaaccgcaggattcaagaaacgcaagaaaaataaacagcaccagcatctggggcacaaagccaagcacagcgcccacgccagccacaataccatctaatatcaggctggagagccagtcagcacagcccaccgcggcgaggaatccctccacaacaacaggtatgcccggcacttccaagccaaacagactccagccttccccaaacactccgtcgttagcccagtcagtggcccaggttcccacggtggtaactgaaacatagtagacaacccacatgaccgccgcaaatataggcagagctaggaaacggttggtgacgatatggtcaattttatcggagacgctcatcttctctctgctcttttttgtataacacctgccaataatggatgtaatgtaggtatagcgctcatttgtgatgatactctcagcgtcatcgtccatggcctcctccatgcgcgctgtgatgcttcccacatccggaaccatggtcatctgggccccaatcttgtcatcccgctcaaacagcttgatggcatagaagcgcctctgcgcctcaggcacatttcctccgatgcattgttcgatttcctccagagccgcctccacatcggcgcagaatttgtgtaccggtacagatgctctgctgtcctttgcaagctccactgccttgttggcggcctccatgatgccggtgccctttaatgcggaaatctccaccaccgggcagcccaactccctgctcagagcctgaatgtcaatccggtccccgctctttttaaccacgtccatcatgttgacagccatcagcacgggaatccccagctccattaactgggtggtcaggtacaggttgcgctccaggttggttccgtccacaatgtttaagatggcatccggccgctgggtaatcaggtagttcctggcgaccacttcctccagcgtgtaaggcgacaatgaatagatacccggaaggtccatgatgatgacatccttgttccccttaagttttccttccttcttttccaccgtgacaccaggccagtttccaacaaactgattggatccggtaagaccattgaacagcgtggtctttccgcagttgggattaccggccaaagcaattttgattgacattttcatatcctcctcattctcttattgagaaaatttatcaataaattagttgtagctaactcattcttttaaaaaaaagcagtttctactgcacttcaatcatctcggcatccgctttccttaaggacagctcatagcccctaacattcacctccacagggtcccccagaggcgccaccttgcggacatagacttccgtcccttttgtgatgcccatatccatgatacgccgctttacggccccttctccgtgaagtttaacaaccgttaccgtgcttttgcattttacttccttcaatgtgcgcatcttattaatgctcctttccttctcatacccgcggccagcttacaccataatcttattggccatttctttgctgatagcaacccttgattcctttacattgacaatcacattgccattgttagccgaaacaacagtcacactcgctcccggcacgaatcccatattttccagatggcgctttacctcttccttgccgcccacccggactatggatgccaccgtaccttctcttaccaatgtcaacggcatactcatcactcctctttctgaacctgatgtgattctgtttcctgaaatttccatattgcagctggaaagttatggtatcctaactgcaaatttaggttagcaccagttaaccaaaatgtcaatcgttttttaaaattaaatgcggattttttgctatttcagtcctgacgctaatttgcgtttcctttcagggtatgataaaatagaaaatagccaccgcagacttggaactaactaatgtttatcagtgggaggatttgattaaattgaaaatacaggaatcagctgaaaattatctggaaacaatcttgattttaagccgcagaaacccctatgtccgctccatcgacatcgccaacgaactggccttttccaagcccagcgtcagcgtggcaatgaagaatctgcgtgaaaacggttatatcctcatggatgaccaggggcacatcaccctcagcagcatgggaaaggaaatcgccgaaaccatgtatgaacgccacaccatgctctcccaatggctcatgtaccttggcgtggatgaacagacagccgcggaggatgcctgccgcattgaacatgtggtcagcgcagaaagcttccgggccatcaaggaccatattaccaaggggcatgagcttccggaagaccttttataaggcacgcagtcagaaatattcctgctgctgtccctgtttttcttccgggttccccggaccgccggtcctgatatacacactttccggccgccccttggtggtggtcctggtcttatatgcaatcttcagatatccctcctgctccaatacagccagaaaacggttggcgctccgcttggtgatgcccagcctgagcgcaagggtcctggctgtgatttcctgcttttcggaggcgctgatagcagtaaatattttctttactgtcaggggtgagagcttggactgcacgtccagcacttcactgttgtccacattaaggagaagctggccgcagtcccccatgggaccgataatctgccccctctcattgatcaggtatgccagagactgcttaagttcagcctcatggcaggcgtcaagagcatttaaccgtgcctgggaaagactgttcccaagaccgcagccgatgctgaaacgggcggacagcttttttaccctcagaaacaggctgaggcggtcctccttaaaatctccggtccagcccgaaacatgtttcttggtagacacgatttccagcccgtaatggcgcctgtggaccgaacagtcaatcatggatgcccctataaattcaatcacaagattttcaagcctcatgtaatcataatccaggccctggaacatctcgccgccggaaccattttccgacagtttcacgatgatgacccccggtatctgctcctccagcttcctgcgctcaatctcattgagaagcttgtcgcacatctcccccacatatcgtttgctggggaacgggaaatagaccttcacaccggccgcctgcagtgccggcacaatactggaaaaccgcgtgacggataaatcaatctttccttcctcccagagccttacatgtttcctgtactcctcctgctcaattccaagcatccgatccatatcaaattcatccgctgaaagctcccggatatcaggcatggggctgcgcccctccacaaaatcctttagtcccactccgaagatttccacaatatcggcataaacccttgtaaaatccaggttcctgttctcatttaacagctttagaaataaacggtacagggcagcctcatcagtgttgaaaaaacagatggggcgcttttcttctttataataaagatgtatcatgtgcgcaggaaaactgccggaagtcaggatgccgtcaaactcctccgtaaccttttcatagatatactgtatatccgaaaatgttttatatgtaaatatacaataatcaaagtccaggtccccaagcatggactggagaaactcttttatatattctgttgcgatgactgcaatctttctcttcaattccattcctcccaaaaccgctttgtcttttatcttaacatagcagaggaaaatccgcaccctccaaatggaaaaacccccggctttttgtcaattgtgcatataaatattttttattctcttgacaatcatggtctttttgctataataaagacacgtctttatatagtctttttatattccaaggagggtaccgaaatgaacgaattcttacgacgagcaaaggaactcgaacaccagatgcagaaggaccgccgctacctgcaccagcatgccgaagcaggggagcacctgcccggcaccacaaaatatgtcatggaacaccttgcttccatagggctttccccccgggaaatctgcgactcaggcatcactgccctgattgagggcagctgccccggtaagaccatacttctcagggctgacatggacgcgctccccatgaaagagatgaacagtcttcccttccagacagtcacggacgcggcccacaactgcggacatgacatacataccgccatgcttcttgctgctgcccagattctgtatgagcgcagggatgagctctgcggcagcgtcaagctgatgttccagccggcggaagaggtctttactggttctgagaacatgattaaggcgggaattctttccaatcccacggtggatgccgccatgggcatacatgtgatgttagataccccggttccctccctcaactatggcacgggcttcatgacgtcctcctgcgacggttttaaaatcacggtaaaaggtgtgggctgccacggggccatgccccatctgggtattgatcccatcaatgtgggctttcatatttacagcgccttccagaatctcatagccagggagtgtgatccaggcgagaaggcaagtcttaccctgggtgcgtttaatgcgggaaacacctccaacattattcctgacagcgccgtactcatgggcaccctgcgcacctataacaaggatttgcgcgccaggcttgtaaaaaggatgcatgagattacagaatacatgggaaatgtctttggaaccacagttgaatacgaatccctctccgaggtgccctccacctactctgacccggatcttaccagggagctggcagaatatgcctctgaggtggttcctgatttcatcaaacacaccgattactccgtaacaccttccgatgactttgcccgcgtgtccgaaaaggtccccacggtctacttcatgataggatgcagggtggatggatgcacggtccagcaccacaatccgggtgtattattcgatgaaaccgttatgccctacggggccgcagtacacgcagcctgcgcatttaactggctgaacaggaggaacgcataatggaacgcaaaaaaatatactatggctggttcgttgtctttggttgtctcatgattacatgtaccatggtgccccccatcatggcgctcagcaataaatttctgattcaggtcacgggtgagcttcagatttccagaagcgcctttaccctggccaataccattctccagggccttggaatcttcctgtctcctgttgtgtcggccagtcttgcaagaggcaacatgaaacggattcagaccgtcagcattatcggctttgtcctttcctacgcttccttctcccttgccaccaatgtgattcatctatacatttcctccttctttaccggtattttctttttaaacgcttccctgattccggtgagcatgatgattaccaactggtttgtcaaaaagagaggacttgccatgagcattgccatggccggaatcggcgtgggcggtaccatcttcagccctgtgatcacatggctgctgggggcatatggctggagaagcacctaccggatcatggcactcattatcctggtactggcccttcccgctgccctgttcatcctcaggaaacgtccggaggacatgggacttttaccctatggcagcgaggattccaccattgagaattcctcccttcaggattcctcctccagggatgccgcctccaaacgaatcccccaaaaggcagacgtggtgtttccgctgagcgtaaaggaatccaggacaaagctgttctttatccttttcatattcggcatgctgtgcaacggactgattaataccggctccctgggccacttccctccggccatcgaggaacttcagggcccccaggtacaggcgttaattatctccatgtattccatgattggcattttcggaaagctggtccttggatggctcaatgacaggttcggcgttgtggccagtactgcctttggatgcatcacctttgctctttcctttatcttcatcctgtttggccagaatatcagcatgctctacatcatggccttcctctttggcctgggagatgccatcggcaccgtcacccctccgcttattacctccgccatctttggcgctgaaaaatacggggaggcatacggaatcgccaacagctttacacaaatcggcctttccctgggagcgctcatggtggctgccatatatgataccagcggctcttacaacacagcctggattctccttcttatcctgaccctgggcaccttcgccggctggataggcgcatataccgcatccagaaagtactgccaaaagcctgcggcggacaatacgcagaatatgcaggccgcgcaataaagccggaagcaaagcgccctcaaaccatttaagtatgtctgaatggtttgagggcgcttctttttcgcttctttttcatttgtgcttctttttcatttgtatttgattctgtattccgctacataaagataccggtatgccgcatgtaaaaggtgctggcagcttcagcctctggaacgtctgtaaaaacattcttatgacaacagtttttcatataattccctgtctccatccttaaacacattaaaaacaatccggtcaaaaaccgtttcccgctgcttcatgaattttgtcactgtatccaccgcaatctccgcccctttgtcgttgggaaaatggaattccccggtagatatacagcagaaggcaatactccttaatccctggtccgcagctgcctccaggcaggaaacataacagtttctcaggtcctgtttcagttcttctgtcagcctcattcccaccacaggtcccacggtgtgaatcacataccggcagggaaggcagaaccccggcgtcagcactgcccttccggtgggttcctcataatccggatcctccctgcgcctgtcatccatgtaccggctgcaggcctcacgcagcctcagtcccgcagcggaatgaatggcattgtcaatacagccgtggcagggcacaaagcaccccagcatacgggagttggccgcgttgacaatggcatctacctgcagccgtgtaatgtcgccctgccatatggatatacggtccccaaacagggcgctgcttccatattgctcctttacggttggtatgtcagacagacccacaatccccttttccctggcttcctccctcaggaattcatcctgaatctccaggaagccggcaggcaggggcccgggcatacggatattcataagggaacgcatgaccctgcgccggtccctcggccttacctccatgtccctgaagctgcccgaatccttcttaagttcttccacaatatagttaagacgtgcttcctggcccatctgcttcatggctgacagctcccctctccccaaccggccccgtcattgcatcctacatctgttcctgccagatactccagcacatgcgcgatgtcagccttcagcaccagtgaccggtccatgatgtcatccggcacccacgcctgctccaaattgacgctgatataaaatgcctgtttccactgctttgtcaatctccagaaggggtattttataatgccgggcgtgttcatacccacgcctaattccaggaaaaccagtgttttttcctgattattgcgcaaaaatgtttcataccgtaccgctgcccggtaccatgcctcatcctccacaaagttaccgtcgcacctcagatgtacttccatgtcgcctccgcacaccggacactttggcacctgacgggagggaatcctgcagtccttctgttccctcagcatggcccggatctgcgcctcattgtcatacagcttcttatgacatgcctgtttgcactggaacagcccgtagtctccctgggttgcaaatatacactcatcctgaaaaccggccagccagaactggtggtccacattggtggtcaggacaaagtggtttttatccttcatcatcccatacaaatccctgtacagctttgccgccggcatgtcgtacctgttataataaatatggcggctccaataggcccacttctcctcctgggtgggaaacggatagaaccccgccgaatacatgtccctcataccgtaccgctctatgaattccttaaaatgatcctcaaaccgcctgcctgcataggtcagaccggccgcagcagacaatccgcttcctgctccgataacaacagcgtcagcctgctccagacgacgtttcagcgccaggagacactcctcatatgcggggttcgggtctccgacatccttttcatcctttttttgtgcttcggtttcctgcactgcggttttctgcattccagtttcctgtattcctattccagtttcctgtattccagtttcctgtgctgcggttttctgtcctctgcctttcatatttccacttccctttgattcattttgccgtcatactttctttattcccgttttttctcttctgttcccgtctgacgccttcgggtatctcctgttctaccacccccccccctcccccagggggggcacgtctcctgtcatcttttcagctgcctgtcccgccttccgccattgtcccgccgtccttccgtcctcctcccggcgcactactgctccgaacggacatacctccagacagtttccgcatcggatgcagtgctccttctgtatttcaaagggcacttgtgccgtggttatacacgtttgagggcatttggaaagacagtttccgcatccgcggcattgcctggtgataaaatatccgcctgcttcctccttatcccaatctccaattaaaaatcccttccttgtaatgggttttacggataaatcaaaatactctcccctgccccgggttacacaaaatacggttatggccatgcggctctccttatcaggatatatctcagccatataaggattttcttcaaataccctgtctaccagtcctgcccccagttccttcacctcgccccggatggatatggcctttttgctgagagaacccccgcctcccgtcattccgctgatggccacatacttccgctctgtcagctgccggtaaaattccttgcccttggctgtaataaaataaagggtattttcatctgccagcataatgtcaatgaccctggccgccggatgtccgtccctgtccacagtggcaaataccgcggaatggatatcatcctttaatatgttcagataatcccctgtatccaatgtcatcccgtcctttccagggcctccgcctaatctgccttcattataccccatccgggaaacgtggtaaattacgcactataaagtgccatggtatccaaaagatactgccggtgtgcctgccagtttcgtgctttccaatttcaccccccccccatgccccgccaaagagtccgtgctccgctccggggccagatcattgagccgtcaaatcatggtatcatccctcatgccctccactatgttgatattgcctgtcctcctgccggctgtccagtatgccatacccacaaataccagaatcgctccccaaaacagagccaggggctttaagggtatgacggacagataatcactgaacgtaaaccggctctgcctgaccgtgaatatgacgaatcctatattgaccggaatgctgggcagaatgggcctaatgcctacaatgcaggcctccatggccaatatccgcgccagtccccccggtgtgactcccactgacagataccgtgcaaattcccgttttctcatataaagtccgcccagggtattggcatatacattggcaatgcccaccagggccagaagcccgcaaaggctgcccatgataagctggtatcccctcctcacattcatctcataagcttcctctgtctgccggttttccagctcatagtccattttcccgtccatcagtctgcgcacactttcttccagcttcgggaccgcctcatccgatacggctttgatctggtaatacacttcccccggaaccctgttccccgccttctcctcatatatttgctccggcatgatgtgtaccagtgaaaaatcaggatattcttccctcaaatccggtacctggtttgtatatgctcctgtgtgcagctgtatacttccacggtccccgggttcccccattccattcccttcatctactgcaacagtcacaggatcatcaaccgcactgataaaagggaggtaagcccttgcccggaaatggctgttcacattgtcccatatccggttgactgtaacctcagtgacagagctgtcaagccccgtctcctccaggaactcctgaaagctgtcctggtccagtattaccatggaaacctttatccgatatcttccatccagtttttggatcccggtatttttaaggctttccagaccgcctgccttcctgagttcttctgacagcatcccctcctccagccaggtatagccctctgccttttcataacggatacaccgggtgaccccggacaggctgcggatgtcccccagcagcccgggcggcatgccgccagattcttctttgaccgcggccattaaatcccaggtatccttgtaccgctcaaaatacgtgtactttgtactgagcccggataatacccagaaattcagaaacaggctgaacaccataaaggacagggtgagggacagggaggatgcccgaaacgcctttcttctggcatacagggacttcctggcaagttccccctccacaccccaaattttagaaaaaagacggaatgatttcacctggcggacaggcttttcccttcctcccatgactgcatccagagggtttacccggctcagctgcatggctgcgcggccgccggccgcgcccactgtcagaacgcatatgcccagggacagaaggaacaaaaggggatgatacgttaaataagctgccttcattcccagggtcctgctgatggaattagccatatgcagaaacagggccgcagcccccacgccggcagcgattcccgccagcacaggcagcaggcttaaagcaagggcctcctgcagcagacacgctcttatctggcccggtgtagcccccactgtctgcaggattcccaactgatgcatgcgctcgtccgctcccatcacaaatgcgtgatacagtaccagtgccatggacagacagaccatgcacatgatgacaaaataaaatccggtgagtaaggaaggctgcgcaccggcctgccagtccccgcccttttctgcagcccgcctgacagaatccacccacatattgtaaaacagggtggttatgaaggaaataaacagggaggagacaaaggctgccgccatgatagaaacagaggacaccctatggtctttcagatatttcccggaatactctttccatatcatatccgtcccccctgtctcccattgggcgcgtcagagacaatacgtccgtcttccaggcggatgatgcggtcagcctgaagcgctatttcctggtcatgggtaataagaatcagggtctgcctgtatgtcctgttggagtacttaagcagattcataatctcctggctgttcctgctgtccagatttcccgtgggctcatctgccagaaccagggcaggggcatacaaaagcgccctgccgatggctgccctctgctgctggcctccggacagctgtctcggcagatgggctgccctgtccctcaaatccagaatgtccaaaagctcttccagacgttcccggttcaccttctgcccgtccagcttcaccggcaatgtcatgttatccaccacgttcagaaccggtatcagattataaaactgataaatcagccccacctgcctgcgcctgaatatggccagttccttcctgttcctggcatatacatcgcttccatccacccatacatggccggatgaggggacatccacgcctcctatcatgtggatcagggtggactttcccgatccggactgtcctatgattgccacaaattcacccttttccacggaaaatgatacatccctcagggcatgcacctgattctcccctgttccgtatactttgcacaaatgttccgttctcagcagctccattttccatcctccttctctcctaacattatcctgtttcaccgcaatcagtataccattttcaccatgacagcccggtgaatttttcataacaatattgtcacattgcggtcagacatacaaaattacggtacagaaaaaaagaagccccggagcgtgacataaaacgccccgggacatgcagatggcgggaatgaatgttcaaacacgctctatacagctcctttgtaaaaccggatgcagaacctagccccgccattctcccggttggaagccagtatggttcccttttgttcttttataatcataccggataaggcaagcccaatccccacgctgtcaccgcaggcattctccccccggtaaaaccgttcaaaaatatgcttcagatctggctctgagaatcccttgcctgtatcctccacctgtatctgtgtatacacaggattctcctctgtgctgaccgtaactgtcccgcctgccggtgtatgttccatgcagtttttgagaatattgcccagcgcttccactgaccacaaaaaatctcctgtataccgggcgccctcctgccctttaagtatcagctgctgtcccttaagttccatgggcaccgccagaggctctgctgccttttgaatcacatcttcggccagaaccagctcttgttttaagaccacggtgccggactccagcctggccatctttaaaagggcggcaatcagccactcaatccttgccagcaggctgcctatgcttcgggatatcctggacctttcctgttcattttcttcctccttaagctgccgcagtagcatgtgtatggaagtcaggggtgtttttacctgatgcgatatatcggccagagattcctgaagatatgtcttgtctgtcctcagctcctctgcctggtccctgagacgtatggtcatcttataaatcttgcttgccaggacagccagctccccttcctcgtcaggtatgccggccatactgtcatttccgtacagcacccggtccacctcccgtgagagctgtgaaagcctgtcatatcgttttgcggtaaaccaaagagatattccgctgcccgccagacagatggcggcagcatacagagcgcagcctatatcccagattatggcggctgccgcagccgctgtaaccagaagcactccgtgaatgcccgtttgcagcttcacctctggatttctcaaccattcagccatctctcatcccaccttatatcccctcccccggacagtctctatgatttccggatgagccgggtctttctcaattttatcccgtagtctctttatgtaaaccgtaagggtattatcatttacatagtccccggcaatgtcccatatctcttccaataaccggttcctggtcagcacttctccctgccggttcaaaaagaccagaaacagcctgtactccagggctgacaatataatttcctgtccgtccctggttacggtccccttcacagtgtccacaagcagatcccccgcccgcagcacagaccggctcctgccccttctcctgagcacgttttttactctggacaccagttccaggggacggaagggctttgcaatatagtcatccgcccccagctcaaatccggtcaccacgctctcctcatcccccatagctgtcaggaagataaccggaatatcagcctcccgttttatggcagtgcagacagaatacccgtttccgtcaggaagcatcaaatccagcaagaccaggtcaaaggattcccgccgtatctgttcaaggctttcctccctggttcccaccgcaacagccgtaaacccttcctttttcagcagaagcaggaggttgcccgcgatgtccctgtcatcctccacaatcaatatccggttcatccccgcctcctttccctgacgtctgtcagcgtttctttaaccgctccatcaaaagcttcatctctcccatatccggctccgcggcatcccagtccccgccaaaaaatcggtaataggaaaacagctgctccagctgcagccagctcccgtccatagccgcagacaacagcccagcaatgcggttgaccatatatttgttcaatgtcttcatatcttgctgagacagctgcccattggcatgcatgtcctcaaccgggccgtttctgaacgcgtaatgagtcactgccttggaaatggcgtcaatattttccctcctgagcagccgctctctggaattttcgttcagctgtgcaaacagctccgaattttcatccataaactgctggtataccatatttttaacggatatcccatacttccttctcttataggccactttccccatggaaatcccaaaccgttctgcgatctccctgtccgtcattccttcctcatagtataaatgcttcagttcttcttctgtcactgtatcccattgatattccatgtttttctccaaatcaatcttgtatttaatgaaaccgcttatggcggggaatgttcctcctccaaacagaatatacataaccatatcttctgtcaacttcgtataaaggaggtttttgcccatgtgcacagctatggtcacacagacgtcccagggggacatttattttggccggaccatggatttttcgtatccccttgagcctgaactgtatgtggttcccaaaggctatcaatggaataatatcatgaacacccaccaggtccgcaaccgttaccgtttcatgggaatcggacaggacatatccccggtggtctttgcagacggggtcaatgagatgggcttcggagccgctgtcctctattttcccggctatgcccagtatgattctccggaccctgaggattcgtccaggcctgcggtcacagctctggaactcaccggatttctcttaggattaagcgcgtccgtggaggaagcagcatccattctccgcaccatccgaatcgttggcgccgaagactccataaccggaaccgttgccccgctccactggcttgtggcggaccggaccggcaaatccatggttattgaaaagacagcagacggcctgcatctcatggataaccctgtaggtgttctctccaacagccctgacttccagtggcacctgaccaatctgcgcaattacatgaatctctcctccacacaagagcagccacagacctggggcagcctggagctgaccccttttggacagggcggcggcagctttggcctgcccggtgattatactccgccttcccgatttgtcagaaccgcattcctaaagacccacacacccattccggcaggcagggaggaagcagccacgacctgtttccatataatggaaagtgtcagtatcccaaaaggcccggtcatcacaggccggaatacaccggattatacccagtacacggccttcatcaatctttcctccagagaatacttcttcagaacatacggcagcagctgcatcacctctgcctctctgcccggcaatccggatacacagtccggcataaaatcgctggcagccctcaatcagccggccggcttttgccagctacccgcgtctcaggacgcgttctaatacctggtaaagatattccacatccacaggcttggtcacaaagccgtccatccccgcctcagctgccgcatctgcatcctccttaaaagagttagccgtcatagcaatgatggggatggaaacagcatcctgcctcggcattctgcggatggcgcggcaggcttccaggccgttcatctcaggcatctggagatccataagaatggcatgatacgttccgggactgctctccgtaaacagttccacagcccgttttccattctccgccctgcacacgctggcccccttcatcttcagaagctcaatggcaatctctgcattcaggtcattatcctcggccagcaggatgttcctatgttccaggctgatgccttccgcccctcctgccttctttttctcctgttctgttttcatctcttcttccacattcgggtccgccagggaaaataccgctgaaaaatagaattcgcttccctttcccagctcactcttaagtttcagttctccccccatcagcctcacaatggtcctgctgatagtaagccccagtcctgttccctggcttttggaataattgggtcccacctgttcaaaggctccgaatacgcgtttctgattctcctccgatattcccacaccgttatcaatcacctgaaacttgtagatcacctgctgattcgcgcttccggtgcgggtcacacgcatgatgatgcggccgcctgccggtgtgaatttaaaggcattggaaacaagattggtcagtacctgctggagacggataacatcccccataagcgtatggctttccacatccttttcaacggtaaactccagtccgcggcgcgtggcctctgcggtcagcatgtcctcaagttcttccacagcccggttcatggaaaatgcctcacttgacaccgtcattttcccgctctcaatgcggctcatatccagaatatcgctgattagccgcagcagatactgggatgaggaccggattttccccaggttttcccttacctgttccggtacatcctccatcatggatgttaaatcgctgagtcccacaatggcattcatgggcgtacgtatctcatggctcatcctggacaggaattcacccttggcgcggttagctgcctcagcccgctccaggctgctctgcatcctggctgcccggatcctggatcgggcagctgccattaccagaatcatcactgccaggaaaatacatgccgtcaccgttacaaacatcaccggattggcatacatcagttccaccacagaagcagatcgggaccctatggttatcatattctggttagtcagagccgtcttctgctcactgctcaggctgttgaccgacttattcagtataggaaacagttcaccgtcaaccggtctggcaacagcaaaacagatatcatttctgtcattaaccagggtattgggaaccacattgggatagtggtgggcctgcatatcgtgctcgattttggtggagattccgtaaaaaaagtccacatccccattgttcaccgcccgcaatgccgccctgacatcaggaaagtatctgacctcatccgcctttatcccctttggcatgcgccgtccttcaatgaccgctcccaccagaccatccgagggatagctgacccccttattcctgacgataatgtcgctcatggatgcatatgcctttgaaggagccagccccatgtctgccccatcctcctcggatcccagaaaagctcctaatatatctgccttgccctgaatgaccagattcagcgcttcccgataggtgtccgtatactcgtaggtgaattccagccctgaaaattcagtgaccttctccagtacatccggtatcaggccgttgtgcatgtctgtatcttcctcctggctgaacagcggatgccattcctttacaaccgcaactgataccttttgtttttcacggatataggccttctcctcatcattcagatagatgctctcaatcccgctgtccggaaaatttgcattataccgttcctctgcaaaattcggattagagtccacaatcttgcccagagccatgttcatgccgtccaggatctcctgattatccggagtggtcacaatataatatggctgggaatcaaattccgcaactacccggaatctctccatggcatctgtgttattccccaaaagcatatccacttctctgtcttccagacactgataaaggttcccatccaccatctggtctttggtaaagtacctgatggtacagtcaatcccattgaggtccagaaatgcctggagcctgcgtatgttttccgcagcccgttcatatacgccaattgtctttcctctcatacttttccagtcatacgtattaatgcttttatcatcacggcgggccagcagcacggatttattgtaacctgtattgtaatccggataggcaaaatactgttcaaattccggctggtaataggttccgcccatcagatcatactgcccgtccagaaattccggaatcatgtcctctgcagccgtatcaatatactcatactgccagcccgtatattttgctatctcattgagatagtccaccacaataccgtgtctggtcccattctcatctgtctccgacatcccctccagctcagggtaggccacccgcaatatcctgcctggtccctgcgccttatcctggtcccccgcacctgcctgcgcatggctgcatgacagcacagacaacaagcacccaaagaccaggatacacgccattcctgctatcttttttcctgcttgcaatgcttttttcatatcagagctccttcttttgtcccatttctgctgtatggtctgctgttatttattttatcacgtatttagatgacttgccatcccaaaaatggcagccccgcagattaaacagacatggcggggtaccacgatataaagacaaggccccgggcgcctcctgatcacatccggccgccaaaaagggccctggttttccaggacccgtggtgataacttatctgcactgcaaaacatccagcacctcacaggaacaatccgggtgcggtcaatatccgcttctacctcagtccagcctgtctcagcatccaggcaatcctggcactttcctccagctcttccagacagaagaaggcatccatcagactttttcccggcaccactgccccatgctgtttcagcagatagccgtcgctgtccattacacgctgttcaaaggcgtcaaacagggcctgggagcccggtttctcatagggaaccaggcccaccttacccagcttcatcttcagatacggggtatgatccggaattacgtctgtttcgtcctcagcaggcacaaaactccacagtaccccataggtgccatgggtatggatgaccgcgcctgttcccggtttcttctggtataccttcaggtgcaggggccattccttgctgggcttgttgccgctcagacatgcgccgttcatatccatgactgcaaattcatccgccttcagggtgccaaaacagcttccgctctggctgatgtacatagttccattatgtaaaaagctcatattggccgatgaaccagatgtcttgccgcgctcaaacaggctccttccaatccagaccgcatcctctaatttctgcgctaactccctatccatcattttccatcctccgtctgcgtcatctccaatactctcacaaaaaaatcttcctgtccaaaattcccggactttaataccaggcgaagtgcctcattctccatgggaaccattaccggcactccgggcgcaacgctggcgccaatcttgtaggaagagaatcccagccgttttgttaccgcgccggaggtttcccctcctgccaccaccaccctcctgattccatgggctactgcccgttcagccagctctgcggctgcctgttccagcatctcagccacacgctcctgtccgtattgctgcacttctttcacgttatgggctgtatcggagctgtaaataagcactggtgttccccagttctctctcacaaacctccatgcgtcctccagggactccctgccttcaagcatggccataggatccatcttatagctgagtccgccgtgggtatggaaatagtcaatctggcccagggtagccctggaacagcttcctgcaatcaggactgcggctccttctgcccggatatcaagctccggcagtatatcctgactgctgctcaaatgctttgccagcggctccagaatcccgctccctcctgtcagcagggccaaatccccgaacagctccacaatccgctccccatcctccatatcctgataatccggtatcacatagtaatgctcctgtgtgtccgcctgatccgagagcatggcacagatttcatctgccggcctgtccatctgctccttccatagctccacgcaggaatacttgctctggggcttcatcagattcgcgattctggcgtcccacatgggggtcaggggatggttcttcatggggctctcatgcagaggcacaccgcccacatacaattcccccttcatcaccacccgtccgttgacaggaagcgccgggcacaggaccgtataggacacgccgagaaattccatggccgcatctgcagcagggccaatattccccttcggagtggagtcaaaggtggaacagtatttcagataaaaccgctcaaccccctgctcctttaaccaccccagagaccgcagggtatccgccactgcctccccggtatcctgggtcctggatttaagcgctatcacaatggcctgtactccctccccaaccctgcttccttttgccggaatcccgttaaagagctggaccgacatgcctccctttaccaaaaatgaagctgcgtcgctggcgcctgtaaaatcatcggctacacatccgaatattggcatagtttacctccctaaagccttatccctctgttatataattcatatggcagactccccgataaatccaccacatcctttgttatgggactgcctgcttttacatcctcaagaagctccataccattcagcagatagaatggcgcaacattccctgcctctttcaattcccataactcagggaccagtccctcaatagaatgatggtgtccctgtaccttcaggatggttccctttggcaaatctctccgggcaacccctgtcatgacggaaacctggcggcactcgccatgagtccctattcccagtatatctcccagtagaatggacatgggagtttcaagacccatgtaatgatatggcagataaacacaggcatatttcccattacggcttaccacatgtcctttgcttgtgagcagtttccacacggtttcattttcgcaccttatgatgataaacacaccgcctgcaaagcttgcttcatccggagcccgcaagttgcagaacacatccacaacccctgtttttttcaaaatccccccatcttcctcaggaataaagatatctgccagctcgctgatttttgcaaccggataattcagacgtgcatccgccggaatcagccctgtgacattggaaacaagattcatttcacaaagatccgccgaaatgacagccatgtatctctctaaaaccttacggcgcccttcaagtgtctcccgtccttcataatgccaaaactccctgagcccgggcatattctcacggggcttttcctctccttccatatagatgaactcgcaggtatccggattccagacaaagtcatattcgctggcctttccggcggctacgatttccagccccaaaatctttccccaggaataaagatccagaagatttctaggctgatccccgtttacaagggagtagaccgtaccatattggtctgcaatatggtttaataccggtccgcagacactgtctgtttctttggaaaccatatatacattgatccccctcttcagagcattttctgcaacctctgagcttaccgccgtattgccggtgcactcgaccaatgctgttatatcactttccaaaaccaaccggtaatcatttacaataatgactgcgttcttggccgcgtcccggacctgctcctgattctcacatacggtaatgctgtcttcatcataccctaatccggtaagcacctctatacattcagctgtatgccttgaagaaataagcctcaattccattgaatcaacctttggaatctgtgctaacaatgtatagccataaccgcgagtcgcaccaatgattcctactctcgattttttcccgctgctgttcttcagtaaagttgtgtaatccataccatgcaattcctttctgttttgtattttattttccatgctcactcgaccaatctgctgctattaactatatcagcaaatatgatgccaaaaccagccgcatgaagaaataaacaaataacagggaaatccattttaaatacaaaggtttccgacaaaaaggaatagaggttaaaaaataactttgataattgtgtaacatatgtgcaacaaagagagggggataaatgcaacagtgttgcatgagagttcatcatcattcagatacacaccggcgaacgcttttgcagtaatataataacagaaagacaggagatttttcacacctcctgccttcttcatatctttccttacacctgtctattgattccgattcactcccccgtaaccggcaatcttattcctgccatgctgtttggcacaatacagcgccttgtcggcacaatccagaagccggatataatcttctgctctcacatccgactggcaggcgtaaccgacgctgattgtaatacgcttaaaggatgagctctcatggggaagtcctaattcatatatggtcctcacgatttcccctgctatgttctctaattcctggctgctgcgctccgtatccacagccacaaactcctctcctccatagcgggcaaagaatattccgcgttcccttcccagctttcccagcgccttcccgatacgctccagacaatagtctcctgcaatatgtccctttgtatcattgtaagccttgaagtggtcaatatccatcatcaggaagctgaacggcccctctctgcggatttcaaaagccgcctttgcgtatatgtcaaatcttctcctgttagggagggtggtcagtatatccgtatccctctggacgatgagaagattttcattcctgatgaaaccgaccctcagctttacaatccagaacgagacagcagatgcaactccgtaaaatacccagcaattgtaaatatccgccagggccagtgagacaggcttggccttaaagctgcatatacagaatattataccggctagaaaattaaacaaatccagcttccatggccttgctatgaaaagaatggacatcacaatcataaacgagtaaaaactaatggccggcatatccagactataggataccccggaaataatacagaaaatataaattttcatcatacaaaggaaggcggcagcctctatgcccctgctgctcttaaacagcatccaccggtctgctgccatctccagcagagtaaatacagccgtcccaacataaaccggctgcatgggagccacatatccggtaaagaaacccgaaacaaacacaaataccagaagtgacagcaccagcgcattaaaaaaggtcaatattccagtattataccgctcgatctctgatctgtatgtatcaaagtactctttattatatccttccagaaaccattcccttataagacgaatcccgttcatacccataccccgccccgcagcatttcatttgtctatcccaatcaaagccctcccagatgtcccgccaagtcgtatatcatctattatacacccattgtatggtttggtgtaaataaactgccctatttacagctttttaccggcccagttttcctatatgctgccgtattccgacatatctcccatgctctgcgggaaagtgtttttcaccgcaggaccgcccggcaggatatatctcttccggtcatccttgattcggttctgcatcaatggttctacttcttcttaatcccatttgcctcaaatgcaatctgcagattggagcgcatcatgcggtccccctcatatcgcttccacatccactcatatgtgtctgtcagctccgcacagggagtccgggacattgcctgcagtgcggcgtgggccagccagtaatcctccccctgcatcagttttgcaaaaaattccgcaaaatccagtttatccgggcattttcccatcacataaacagctgtacgcctgtcctcgctgctgttttccatattttctgcaaatcccttcaaatccgcagccttcctgttactgcagtctcccagaaaaaataagatacgggccttgtcctttatatcagggcggtacagcagacccagcattttcccgtaaaaccggtccttatactggtccggcattctcctggcgcaggccacggctccctggggatggtttccaacgatagtctcttcaaataccttcagccctttcattggcgccagtttaaaaagcagctctccctttgccccatctgtctccggtctgtcccgctgtaacagaagctcaattgtttcaggctccgcctctgtaaacttatggaatcccgccagaatcctaagcttgtcctctgtcagaacagctcccccatactccttcctgagttcctgctgggatttaaggctgatataaccataggatgtaaggctatgcccggccagaatttccaggaaatactgctcaaaccactccaaaaatgtgagacccgttaaaaagggaccgtattccggctccatattccagtctatatatacaatttttcctctctcgctccccttccacatcagcagattatcgtaggtgcacccctgggtgcctatgaccagcaggccggagcaaacctgcttcatccggacatcatattcattatcatcatttatatcctccatctcttccatggcccgcgcccagttaacaggactcatattccggtcaatgaatgagggcagggcttccttatccctgtcatcatagaaccccagatattcgttataccggtccagattttccagggagtaaaggccataatacggtcctgcgccgccatttcccaccttggtgagaaaaaatacatattcatccggaagagtcaggtgccagtgcgcctcaaacctcctgacctcctcctgtgtcacggtgggattcagtttgtatccatgtttggacgaaccgaaaatttcacgcgttccatccttttttcctgcccgcttaactaaatcctttaggtacgcggcatgggcgtccgacaatggttcatatgtattagacggattgggcggattgggcggcctggattcctgctttcttctcaaatatgccgacagctttccccttatttttttgcctggcatacctctccccctgtctcatccctgccgctggcttgaacagcaagcaaatggtcgatattccggatgtcatgcttatccacttccctgagttcataccctgtatggaatactttctgcccctttgccgagatacacggtatggtcctgccctcaaaaaccgcgcttccgaaataatccgcctcaaattcataccagccgccttccaggtccgcctgctttgcagttccatcatcattgattacaaatggatggatgtccacataactcagctccgggtggtaaagttcaatccgcaccgggcgccagtccgtcacgatttcatagcctatggaaaccaaggtgtcaagcagtacgtcagtgcaccgggcatcaaagttgatatccacatccctgtgctccctggtctgtttccccaccagcacgtccacaccccagccaccgtccagccagtactgtatgccggatgcctccatcagatccaataccttcaataaatccgtctttgttactgtctcttttttgatcataatacctccgtctttctccatatacagctcatataacgtttcctgtcactgcatcaagtttaccatattctcccgctcatatctaccaggttccgcagctgatgcaaagggttgatgctaacccctgaaaaaacaagccggaaggatccatcagacctcccggcttattccagatatcctggcattttttccccagcaatgacatgtatatcaatattcccggacattttcttagggctcttttcttaaggctcttttctaaaggctcatgtcctctcttaaagtttctcaatcagctgttcaagctgcggaaccggctgcatacattcatgccccacacagaggtaaaataattcaccggtatcaggcaccggataatcttttgtatagggtataagacgctccatttcccgtgcattttcctctgtttttaccaccacagtcagaccttctgcggttacggccagattcgcaagctgagcagccagcttcctgcgcctttccgtgtcagagccagacgatagcgtacataccagctccttagcgggatacagcacatccatcatggtcagaagcccatagctgtgcccggaaggatatccgtccatagcgcctgccaggtaacagagctgtttctccagcaccttctgccatgtgacatcaccggtaatctgggtcagccggtacagtacctgagctgccacggaattcccagacggcatggcaccgtcataggtttcctttgtcctcacaataagctgttccccgtccttggcatacagataaaatcccccgcgttcccggtcaaagaactgttccgtcattatctccgcccaggcagctgcccttttcaggtaatcaacccggaacgtcacccggtacagctccagcagcgcaagactataacaggcataatcatccagttttccctctcccgctgcatctccgtcacggtagcgcaccatcagacggccgttctttacaagatggctttttataaatgcatccgccctgacagccatatccacatactgctcttcccccagcactgctcctaccatcgcgcatgcacaaatcatccaactgttccaggaaaccagtatcttgtcgtccttgtgaagcctggcgcggtcaagccggtattgatacagttttcggcactcctcattttctctgcctccaatggtgtcacaggcgccatgacagatattgccgccatggtcaccattgccccacggttcctcacaaatctcctcataattatcattttccagcaggttgggtatgctcctgccttcaaaattaccatgccctgttattccatattgccggcaaaagtccctgcccgctttctctcccagtacctcccttatctcctcccgggtaaatacatagtattttccttccacaccatcgctgtccgcgtcctggccgcagtaaaagcctccctgggaatctgtaagctcccgcctgacatattccagaatcttttccgccacacacccatacatcttccgcccggtgcttccataggctttgatgtaagccatgacaagcaggctgttgtcgtagagcattttctcaaagtgtggcaccagccactgcccgtccgtggaatatctggaaaatccgcctccaatgtggtcaaagataccgcccctgtacatctgcaccagggttttctctgccatggccaatgcctccggccgcttctcccttgcgccatactccatcagaaatatcagattgtggggggcgggaaacttgggcgcgcttccaaaaccgccgtttttactgtcaaaacaatccgccaactgcctgaatgcctggtgcaccgccccaagctccggctcagcctgccttcctgtccgttcctggctttttaggtatttctctatctgacctgcctggtccagaagtttttcttttttcaccttccactgccctgccgccgctgtcagcagttcttccagacccggcctgccataacgggccctaggaggaaaataggtaccggaaaaaaagggcctgcagtccggcgtcattatgatagtcagcggccatccgccctgtccgttcatggcctggcacactgacatatatacagaatccacatccggccgttcctcccggtccaccttaacacagacatattccctgttcaggatttccgcaatcacctcattttcaaatgattcccgttccatcacatggcaccaatgacacgtacttcatccgggacaggtcagctgtacccaatagataagaaaacaggcttattttccagccttgctttctcaaatgcctcctctccccacggaaaccactgcaccggattgtacgcatgctgcagcagatagggcgatttctcattgattaacctattgggtctgttgttttgattgtccacgatatcacccccttatgaacgaatatttgcccttctatgttctccaaggatatgcaaaagtatacccttctgctgtcagctactatgtctgtgatttgaaactatattatggcagaagtacgattctatttatagaatgtttcgccagcgtaactctgccggactgtgtctgcataatgcgtgcagccggtacaatggattcatccggcaatgtgttcatatcggaagttttctccgaagtaatggtggtgatttctgctttttccacggttttatttggagtttcatatttaatttcaagaaccgcttcctggtcgcaggaacggttcagcgcaaaaataaccgtattcccattttcgtcaaggcaggccgccccgtccacgtaggggacaccggaaagcggttctatatttccaatctgctcagacgtactgtaggttggcgagaaaacatctatgtctaaaacctcttttaaacggcttccggaatacatggacataacatggtacgttgcagtcccaaatgcatggccgtccttgcttacaatgcatcctccgggccatccattcaccaaatctgacaaattacacatggcaagcttatctgtattccttaaaaacatattgagcatgccggcattgaaaatagcggcctctaatgtctgttcccggtaagagtcaataatggttcccacattatactctgtaaccgctgccatggcagccggattgccgcttttgcgtatggtttcgcaggagtcgtttaaaattccttcgtactttttcacggaaccagctgttgcgtagtagatatccctgctgtcatgctcgccctgtatctctttctgtgaatacatatggagacataccacatccattttgtctccgatgatttctgaaatcttccggttccattcctgggaagtgctgtctccgtccccgccgcataccatgaaagtgatggtcggatccttttccttcatggcttcataaaaggatagatacttgaccgcatatccggaggcatccagatgtcctatttcccaatcaccaaaggtttcatttccaatatcccagtatttaatattccagggttcgggatggccgtgggcagcccttaaccgaccgtaaggcgtgtcagccaagccgttgcagtattccacccagttcgcagcttcctccgctgtcccgcttccaaagttgacgcaaatcataggttcacagccgattttgcggcagaattccatatattcgtccatcccaaagctgttatcctcgtaaccgccccaatgcccatttttacggaccggacgggtgtcccgctcaccgataccatcctcccagtgatagcagtcggcaaaacagccgccgggaaaacgtatgacagcaggggaaatgtttttaatccgttcaaatacttctctccatattccgtctaccgtatcagaaggcataagagaacagccatccacccataatgtacccgctgcttttaagcggatttccattgttcctgtgtaagtaactgcagcggatcgaaagtcaaaacagtattttttccattccccgtttacagaaatggttttacttaaaaattcccgtccttctttatcgtaaatttcaatggaaacaggaacctcctgctcagacttcatccagacatatccttcataccttccattctggatacataaaccggtctgcgcggttcctgcatacccgtcataatggtttcggtctgttatcttaagagaacagccttctctggaaatagtgtggtcccaatcctgttcaaagtgaaaggcatcttttacacctgtccggtgccagaaatcagggactccgtcttttacgtgctccgatatttcaaagctcctgttttttaacagctgcgcccacatgccttcgtcgatacagtctctcatatattctatgaaatgtccgaaaatcagaggatttacaggccttttatttccttctttgatagtaatttctgctttcatttgatttatcctttcatacctgtcattgcgattccctgtacaaactgcttctgcgcaataaagtaagcgattaagattggcagaagggacaggcacgcgcccgccataataataccgtattcgaccacatgggttcccatgaaggtggcaagaccagagggaagggttttcatattatcatccgttgtcaggagcagcggatacaataagtcgttccactgatacataaaatgaaatatgaacagggatacaatggccggtttgcacagcggaaccatgattttcctaaaaatcccgaattccgtgcagccgtcaatccgtccggcttcttccagacctttgggaagggagataaagaaggagcgcatcatgaaaataccaaacgcattggttgcccgcggaaggaccagtcccggatacgtattgataaggccaaatttaaaaatttcaatgtagagcggaaccatgattacctggaagggaatcatcatggttcccataaccagaagaaacataatgttttttccgggaaaattcattctggcaaaggcataacctgccatggtgtcaaacaccagcgatgtgacggtcactgctgtggagaaaataatggtattgcggtagtattttaaaaatgggacccgtttccagatattgatataggaatccagactgaaccttcccgaaaacagctttggcggataggatacaatctcggcttccggtttaaatgatgtcaccagcatccagataaacgggtacagaacgataaaggccagggctgcaagcaggatggttataatgatttttccggcatttttccggtaaatgttatttgtcggcgtcatgtgtattcctcccgtcagcccaaatcttcttcaccttttgtcatatgtttaaaggtgaatactgaaataataaaggtgatgataaacagcgccactgcaatggtggacgcgtagcccatgttgaacgaatcaaaggccatgctgtatataagctgtaccagtgtctgtgtcttaaataaaggtccgcccttcgtcatgatgtatacctggtcgaatacctggaaggagcctatgatgcagttcacaaccgtaaaacttaacgtcggcatcagcatggggatggtgattcccctgaatttctgaaatccggtggcgccgtcaatattggcggcctcataataagactcatcaattccatttaatcctgccaggaggatgaccatattaaaaccaaaatttttccatacgctgacaagaatgaccgtaggcatggcccatgtgggactgctcaaaacattgattgggttgaaaccaaggagttttgcccagtagcagaacattccgatgtccggattaaccagaaaactccaaaggatggaaacaatggtcatggaacagatggcggggataaaataaacagacttaaaaaaaccgttcagccatccctttctttttaccgcaaccgccgtcacaagagccagcccgatttgcacgggaaccgtgaaggcggtgtaataaaccgtattaaaaagggcattccaaaactttttatcacccgccagctttgcgtaattacccagcttttgaaactggaaattctggaacatcatgtcgaatttgaaaaagctgaatataaaagcgataatcagcggaataaatacgaatacggtaaaaatggtcatggaggggagaacgaaataaaggccggctctttccctctttctttccagtgaagttttcatcatttacattctcctctacagggtcctattccagcatgctctgaatgatgtcatttgcttcatccagggattcttttacatctgcgttctgcagaagaattttttcaaatgcaggagtaatagcctgattctcaatatccgcaaagttagttaactgctgcaaatacatctggctctcatttgccggttttgcaaattctttgatatatggattatcgtttaaacgcgcatcgtccgcgatatcagttcttgcaggtggaaatcctgttcccaggcaccattctacctgtgtgtcaacagaattccagtatttgaaaaagtcgtaaaccgcctctttattcttactggatgcagttaaaaacatgccaacaccgtttgcctgtgttacctgctgctctggtccctttggcgcctgcgcaacaccaaaatcaatgcctgcgttcttaaatccggtggttgcccatggcccgcagaagtacatggccagcttctggctttcaaacagcttgtcaatttcacctccggttaaaacctccggaccaaatttcttgtcacggatattttccgcccacctggtgatggtttccacattttcaggactgttaaaaacagcttttccatcttttatgaaatctccgccatttccccacagcatgatacaccacattggggttgtctccttaaccgccatgtcaaaaccgtattttcctgttttctccacaatctgctctgcatactgctccagttcatcccaagttgcaggaggcgtttccgggtctaatccggcttctgtaaagattgttttattgtaatataaaagaagggttgcaaagttcatgggtacgccgtaataggtccccttccactttaaattgtccttcagcgcatcgggcaccactgattcatcaatgattccatctgcataagcatcgtcaacaggcgccagggcacccggttccgcatacgtgccaaggcgctccggagcaaatgccaggatatcaggcccctcgcctacgggaagtaccgtggcgagcttctggtaaaggctgtcccagggcattatattcatctgtacttcaatgttcttgtcattggtatcattgtacttttgaacaagtgcttccagggtatccttatcagaacccgtaaaaccgttccaaaaggtaattactgtttttccgccctcagatccctctgtctgggccgcttcactttttgtttctgccgttccattggaaccggaacatccggttaaggcagctgacgccgccatgattcctgccagtccaagtgctaataatctctttctcattttcttcctccttgtataatggttcttattttttcggcatccactttgtcccgtctgttcatatccatgtgtccgttttgttcctgctctacgtcggtcagctgtgtgtaacaatatccgctgataaaatccatactatatatcgcgtctgtcaggctattcagccgttccagataacctccttctgatgtttctgcgttcccatatccccacgccttttcatccttacagaaagcgattccgccaaattcacttaaaataataggctgtccctcataacggaaaccgccggcaaaggcatagcgctccccgttaaaggattgggtattggacaggttttgttcccaatccgtccagtggctaagaagatcctccccatattccgcataatcatgaagtgttatgatatcggatttcgtgtgctcccatccgtcgttgctgatgacaggccgggtggcgtccagggatttcgtcagatagtaaatggcttccgtaaaaacctgctgttttttatcacataggattcttggaatcccccaggattcattaaatggaacccaggtaatgatggacggatggttataatgctgttttacaatgtcaacccactcttttgtcacacattcaatggccctgcggtcaaattcatagaacgaaggcgcctcgcaccagacagtaagaccatagacatcagcccagtagtagaagcgttcgtcttcaatcttttggtgtttcctcactccgttatatccatattccagtatttttttaatatccagaatcagcgcctcttcatccggcggggtcagcagggacgattcccagtagccctggtccaacaccatctttaaatagaagtccatgttattgagttttactctgccggaatcagtggatattttccgtaaaccgaaataggagccaacctcatcaattaccttcccatttttataaattctgatgcatacatcatagaggttaggtgatttaggacaccagtatcgtactttccacttgatttcatcattaacaagagagatttttttggaaaacgcattttttatgactttatcttttccggaataaatggtaaaattctcaaatgtaataatggtttcaatttcaaatgaatcagagctgtccttccataaattcagttcataatcaacttccagggaattttcgtcatagagaggtgttaaataaagggctgttaaataactgctgtcagtttcttctgcccatacatccttccagattcccgttgtctgggtataccagcagtcataattttgtttaagccaccgctgttttcctctgggctgtacggttgaataggtatcttcaatgcggcagaccagctgattccccgtttttttaagtgcttcggtaatatcaaaggtgaatctggtatatccgccttcgtgaactcccatataaattccattgacccagagctccgtccggtaatccgatccttcaaagtttaaaaggattcttttcccctcgtgaagttcaaatgactggcttctggaataccagacaacattacattcatcctgtaccccaattccgcccgccggactttcatacgaaaacgggacgataattttacggtcttcaaatccattctgccatccgcatttgattccctcctttcggggatcgaatctgaagttccattctccattcagggagaaaaatgattccctcacaaactgtggtctgggatatccttttttataaaattttgtcatggcaccctcacatctttacttgcagttttaatgtacctttaaaatagcactcattgtacaaaatgtcaatatattatgggtataataataaaatatttgtgcatatttccaaaattaatgttttggtgtggtttgattaatacagcattactgtaacaaatggcagaattaacattctatctccttgttttttacttttacacccgatataataaaacaataaagcattctgaatgggtatggctgaaaaaggttggctatgcaggaagttggatgtgtgtaaaagtcggctatgtgtaaaaattggctatgcataaaaattggctatgcataaaaattggctatgcataaaaattggctatgcataaaagtaagctgcggggggtatctatgaatcggcaatcagcaaatgaaaaagaaaagatagaccggcatattgtacttgacattgattcggaagagaattatgaattatttgaacggcttggaaaggcgctttcatccagagtcagaatccggatgctggcgctgttaaaacataagtccatgaatatcgtggaactggcgcaggtgcttacgattcctgtttcatcggctgcatttcatgtgaatatgctggaagaagccaatctgattaatacagagatgcttccgggcgtccggggttcccaaaaagtatgcagttccagggcagaggatgtgtttctgtctatcaacacttctccccaggagaaggagcggcggtcattcagcgtggatatgcccattgggaattattacgatttcaggattcatccgacctgcggaatggtaaacgaggaaacctacattgattcctgcgatgatataaaatctttttactcacccggcagaagcgcggcacagttaatctggttccagaggggttttgtggaataccgcttcccgaaccatttcatcagcggcaaaaatccaaattatgtatcattcagcctggaaatctgctccgaggcacctggttaccggaatgtgtggccctccgacattacattttccatcaatgacagggaacttcttacctatacctctcccggtgattttggaggaaggcacggaaaactgacaccgatctggtggacagacggaaacacacaattcggtcttttaaaaacaatcagcgtggatgggagcggaacttatttagacggggtgatgaaatcagaagaaatcaaccttgatacccttgcgctttcagcccagccctatatctcttttaagatagaaattaaaaaggacgcaaaacatgtgggcggaatcaacattttcgggaaatcatatggagattatccacaaaatatagtgatgcatgtggagtattgaccggcaggggccggttagcagaataaaaaggcggggtgaaatcagacgtatattaaaaaacgggccggcggtgaatagccggattcggcaaggccggcagaagaaggccggattcggccttcctgaaaatcttccggtacccatacctatctgctcatactgcggatatcatagacaaactccttacggaaatagaacgcatggttcttatttgaaacattacggccatatactccggaataaatagggcgatacggcattgaatccttgctccgcacctgtatatgctgtccgttggatgtatgtatgcgcctatccgggcttgtctctatgtgcatcctcagctgcctgcaaatggagtagtaatctgaacgccaaatatcccgaagctgcgcatatcggggcgaactgagatcgatatggatgctgggcaaaaacatccagtctttgggattgccgtctttacagaccggcacatataaaatattgctgattttttcgtacaaatgcgtttcctcaaagggacgctcctgaataagttcatcgatcacactgctaatctgtgtaataaaaaccgtttgctttggattacccgcattatcacacttgttagttttcaattccccatcatcaaaatccaggtttgtgctggacaaatgcattcccagggccagctccaaaagctggcctgttttccctttattaatgataatcatgttcatatcgttctggctgaacaattcctcaaatctgatacctgctaatttattaaaccggacacacgcttcttgaagtctcatttttttctccttatggctggtatactgattcccaatctgtttctcccgcgaacgttgcccctgcgaacaccttcatagcctcctcttcctcaaactgcctggaatacagttcataataatatcccttttgctccagcagttccggatgactgccccgctctatgattttcccgtcctttacaaccaatatcaaatcagcctgacggattgtggataaacggtgtgcaatcacaaaggaagtatgtcccttcagcagatggttggtggcatcctgaatcagtttttccgtctgggtatcaatggaggaggtagcctcgtccagaacgaaaatggctggattggccagaaccgcccgcgcaaatgaaatcagctgcttctcgcctgtggacaataggcctccgctttcacccacatcgctgtcataccccttttccattttcgccacaaccatatccgcagacacattcctggccgcctcttcaatctcctcatccgatgcatccaggcggccataccttatattttcccgcacagttcccgaaaacaggtgcggattttgcagcacataaccaatctggctgtgaagccacagctgcgaccgttcccggtaatccacgccgtcaatcaatatccttccctttgtcggttcaaagaaacgccccaccaggttcacaagggtagactttcccgcccccgtctcacccacaatggcaacattcatgccggcaggcacatgaaggtcaaaatgttccagcacatattccttcccgtccgggtacataaaggaaacatcctcaaacacaatgtctccctggattttttcccaattacacttattgggtgaaaatgcgtctccgtacttcctgagcacatcggttctgtccaccacattgggcttttgttccagcagatccatcacccgctcaatatttgcctgacaggaaatcaactccgccagcagcctggcaagctgctgtatgggttcaaatataacaaccgcatacgagataaatacagacagcgtccccagtttaatgatattttcctggaccatatagccgccctttgccaacaccacagctgaagccacagagctgaaaaacaaaatagccggaatatagaccgcattcagcttagccgaacggatcgccgcctgatgcatatccgatgtcttttcaaagaagcgtttttcattatccgattcaatgaccatactctttgacgtcttaaccccggtaatgccttcattgtacgcgctggtaatctgggaattgatccgcctcaccttccggttccatttcagaatccgattctggaaatacacggtcaaaagggcaatacacggaacaatcatggtgatgataaatgccagctgcgcgttcagcataaacataatcacaaacacactgaccacataaatcagggcccagaacatatccaccaggccccaggctatcatccccgcaatcctcaaagtatcactcatcacccgggcgtggatatatcccaccggagtcgtattatagtaggaaaacgacaaggtctgcaaatgtttaaactgcgctctctttaaatcctttcccacattcatctctatggatgtagccgcgtgaaccgacacatacacacagacagtctgggccacaataacagaaatataaaccagcgtaaatactccaagcccatccaaacgatccgggataatgaatgtatcaatggcatagctctggaacagaggcacaaggatatccactcccgcaagcagaatattaagacccagcgtaattgcgaaaaacttcttatacggcttgaaaaacggaaacagcttcatccatatgcggaagctgaagggattattatactcctgttcttcatatgctgccattgattatccccccatccatcttatcctctttcttcttatcctctttactcatcttatcctttttattctttttatccttttcatcctgtcccatcatgtccctgtcatcacggctcatctgtatttcataaatcctgcgatagattccattcctccgtatcagttccccgtgggttccacgttcttctatttttccctgattcagcaccaggatttcatctgcgcccataagagatgtcaccctgtgggatatcagaataactgtagcctccctcatatgttccttcagcgcgcagcggatgcggtaatctgtctgggaatccactgctgataaggaatcgtcaaacaccataatgggagctttccgaagcagcattctggcaatagcaatcctctgcttctgccctcccgacaaagtgactccccgttcccccacaagagtgtcatatccatccggaaaactcataatggcatcgtcaatacacgcaatctgagccgcgtaccgaatctcctccagagacgcgcctggtacggaagccgctatattttcccggattgtcctggaatacaaaaagggttcctgcaataccattccgatatttctcctgagctcctcaatgtggatgtctttaacagctctgccgccaatacagatgcttcccctgttttcctccagctcatagagccgtgaaagaagctggattaccgtagacttcccgctgcccgttccgcccagaatcccaaaggtgctgccttccggaactgtaaatgaaatatcccggagcacatcctttccttcctcatatccgaaggatacatgccggaaggagatatcatactttcctccggaatgttcgcgttccttcccgcctttttcatctgtctttccataggcttcttcctgggagcggatgatataatccacacgttcaaacgaaacgccagccttgctcatatcagaaagaatacgcccaaggccgcggattggccacaccagcgttgaattgtaagccgcaaacgccacaaattcaccaaccgatatggaaccattcacagcttccaccactccgaaaataataaccgcaatcacctgcagccccgttatcagatccccaatcccccaatacagtcctgataacgtccccagacgaatccacagcttggcaaaggcattattcttcttgtcaaaccgctccatctcaaattgttcccgtccgaatgcccgcaccacgcgcactcctgttgcattctcctgcacgaccgtggaaagttctccctctgcctcgtccgcagtggtaaaccgcttggctatcagccggtaaaacacagtggagtacaccacaaccaccggcacgaacaggagaacgatgcaggaaagcttcacattcatggaaaacatcatgacaaaagacgtaagcacaagaaaggccgtgcggaacacctccagaagctgggtaaccacaaatccgcgtatcacctccacatcagaagtacaccgctggataatatcccctgtctggttcctgtcatgccatctcatgggaagcttctgcacatggatgaataatgtatcccgcaaatttttagcaaaattctcccctgccctggctgtattggtacggctgatgtaggtaaaaataccggaggcgattgccaccgccacaatcatcagcgccagaacccagaggtggctggacaggtaacttccgctggttccgctgcttcccatggttccgctgcttcccatggttccgctgcttccactgagcacctcatcaatgctgaagcgaaaaatctgcggtgtcagggcatttaatatggttgataccagggatgcggctacggccgcggcaaaatagagtttggagccctggaggaatctgaatatcagatggagttttctgtgtttggggattgtgtttttttgtatgtttttcatatatttaccctttttcaaatcttatggtatgtcattcctattttaccatacatctatatttttaccacttatatccgcctgcaattatcagaaaatagggcaatttggctgctttgttcatcagataccaccgttctccttacaaagctgttttgtgtcccgaaataacggcttaaatctttgagttttcctgccactattgcccgccctgaaaaagggattgtgcacgcggccccctatccccgacaaaacatctattcacacacattaactttatccctattcctctttctttaatgcaatctccaaaagttctgccgccacttgcgcagacttaattctcatcagattatcccatgcatcttccttacccaaaaggttcataccgccatgccatacaagtccgtcatccaggactgcaaaatgctctgaaacttcatcctttaaaatcacaaaaataccgccctgctgcatttccttcacaagttccctgacaaactccgaactgccatacaaagcgttttgaggattttttataataaccgtcactttacatcccgcttcctgcctcgtcttcacaagaaaaaggaagcgttttactttatcccaggtaagttcggggcatgaaacaaaaatcgtcttttctgcctccacaatatcccgttcaaaaacatccgtataatttccgctgtcataaatagcatttgcggtctgtttagaaagacttccatttgagctgagatgaaatccgatatgcttatatgtcttcagccttttggcatacatattgtcaaaaacactgatatgggcatcaatgtaatcatatacaatgaccttcgtttttccttcataatcacgatttaatcttcctaaatactgctcaagcctgtccgaaaaagataccggcgccgcaagcatcagtgtatctaatctgggacaatcaaagccctctcctattttctggccggtagctaccaaaataaggctctgatctttgggaacctctcttaacttctgtctgatgccagaattctgcttatcactgttatctccatagagaatgaatacatgatccgcatccgtttgcagatgatcccagagatattttgcctgctccttgtacctcgtcaaaataaccggcgttctcccttcctgcacacagaatctggtatcatcaagaatcatatcatttctgacagcgctggaactgattaaagaatacgctccattaatatcattcttattttcacgggtatcaaccactcttgtataccttggatatacatagtggccgattccctgcgccatggcccgttctttggcagtataactatggcgaatcggcccgatcagcatataaataagtttctccagattatctcctcttttgggtgttgctgaaacaccataaacatacctggcattgaccttttgcatcaattccaccgaggtagcggaagcacaatgatgacactcatccatcaataccattccataggaattaaataactcattaaactccccttttctgtatacagctcccaccatcgccacgtcgatgataccggtcagcgtattttttcctccgtgcagaattccaatggcgctctccctgcgttttactctgccgccttttgttttataaaccggcggctcctcatcaatatttaaaaatttgttcaactcccctacccattgttccaacaaacctttactttgaagcagtatcaatgtatttacttttctttccgaaatcagataactgcatactgcggtttttccaaaagcagtagccgcactcagaaccccgtgttcatagacaagtaatctttgtgctgccagatcctgctgtattctaaggtcccccttaaaggaaactcgtatgggccttcctttttctctgtggtccgcaatttcatagtcgattcccgcctccttgcaggctgcaatcaggttgtcttgaagcccccttggaatacaaatgtatccatcactatccctccccatataaactgtgctgaagttataataattggaataccccagcctgctgtttttataaaatacaggattatcaaaggctgccatacttctgatttgattttgtaagcagggaataagattaagcgcgtcaatataaataccatctcccagaacaatgtgcatttttccaataacatccgttttagaaaagaacagctttttcttccacggtttcggcctgttccgggacagtacgtcatgagaaatgccgcaaagctcagcaagctcttcctgccattttgccataagctgtgcaattttttctgttgagagcttttctgcatgattcataagaaaatcccactggtccggatatgcgttccaattcttatcaacaaatgcgctgttgccatttttaagcgcactgccctgtaaagggagcgctatcagattacctatactacttgccgtatcctgagaaggatacatgcggtcataataatgaaatgacttcaaattaatggatgctgagcctttatccaataacaaaaatccaaaacttcttgccaacgcagccgatactggttttttaaaaagaatccatacatgggcgcctctgccagaccgtgaccgctctaccaagggtgcaataccgttgctctcacaaatcaaccgcaaagcatcgacttcatcatgccactcctctgtaacattggcaaaatcggtgatctccgcgcccttttcatgataatcaaaatcaaacacaataaatctgcacgttccgtccggaaataatggatatacccccaatacatccgtaccgtcttccctatacccgacaaggtggcttatgatttttttaggcgtaagatttgtccactctgtatgcccgcagtcctcacaatatattttctctccacgctgtttgggacatatactggcatcccaccggttattacactgaggaaaatatcctcccttggctcctcttctggcatatacgtccgttcttccccaaaacatggaaaaaaactgatttgccaattcctttgtaataaatgtatcaagaatacgcccgccctggtcagggtcatacgcctctatgcaatccagcttcttatcaaagatatccgccgtctcatatgcaacattcgcctgatccagcaaggccttcaaccgaaggttttcatcttgaagactcctaatcagcgctcgaagcgaatccagattatatgcctcaacattcatggaatcagtgccttccccctcttaataattacatatttgcagctttctgccggaaagattattgaaacggctgttcttcctcaaacaacgacagctgatgatacccgtcctttctgtctttctcatattcaccccaggtatatcccttcagcgcagctgatggtaattcgttacggaatttccgaaacaccttccgtatagccttcgtcaacgagagctggtgttcagccagagcctcactgatccatgcaaaatattcttcttccttatatcccatagcaacacattttaccagctgttccaaaaaatcttccgccgcctccggtctccatccccgctcaaagagcaggtaacgaaatgtttctccataaacagggcaggcggcatgccaaccgcccgccctcagcatatcctgcgattccctgctcaaaggacaatagtattttaccgggtatttttccctcattttcagtatttcttccgtaatttcactgcaaaaaaagctgatgtatgatgttccatccgccgttttcttacaattccagaactcccaggacttaagtttttctgccgtatcttcaaacaattcctttgaatataccgaataaataacattttcgcaaagcagttcataaagaatatcctgctccaccactccatatattccggctaatgataacagtatatgttcaagatcatatcgctcctgaagcttatcccaaatattatagctcttgtaatgttcctttccatgctttactctcaaaaacagatgtgtttcactctcatcgacctcaaccaaaccagccctctccaaccggttaaacagttccatttccctgtctccggctgcgacaacatctttgttgaccaggcggagccacatgttctggagctgcgctggaagtggtatcaatttatctttgactactgtatcttgttcgtctaccagagtaatgaccagatcgtccgtgaattcacaaccgtattcattacagttgtctttggcatcccaatcgtcttcatcatcccaaacattcccatcttcatcccaaacatcttcacaatttggatattggcataatgttccctggctctgtactactttggcagatattttctgatctgcctcccagattttcataactgtgatataaaatatccattcatcgccaaaatcatatagataaaggtatttatttcttttaaccggatcgacatcctgcaagcgaacccggtccgcacgtttttccgctctccctccaggagaataaatcccgttggggtcatagggttttctgcccaagctgaacatatataaatggtcgtgatcgaattcaaaagcgtccaatattaagtcgctcaaagccgcaaaggtgcagcttccatcaagctccaaaaaccggtagatattggaattaaacgctggtatgacttttaattgatagcataggttttgcatgtattttatctcctcttccagcaatttgaacagttctcaataataatcaaaccatcttcggtataccttggatagtctacttccaccggaacccttttagtgacaagtttcttcttgccacttggcatcttcttgattttttcatgtatttccgcttctaagaaacaactcctctgaattgttatcgtcccgtcataaacgtgtgcctcattcctgtatttttcctcactcagattatagccgccatactcatagatgactgtcttatcatcttgcaatacaagattggcatgcgctcctatacctctgcttataccgcactcctttcaggcaaatcaaagtgtgattctgcaattgtattcagttgtcccgctatctcattaaaaggcaaatttaaatccagcgttcttactgttatctgattaccgtgcatctggtacacattatccggttgaatttcctcttcggtttttgcgtagagaagcacccctgaaaccttatgctcatcttctccaaattcgtaatctcgattcttaacataggtaaaaatctgatacatattatttgaatgaagcgtatgcttatcatactgagtttgtgttgtatgactataatacttagcgtcaataacgagcactgtattgtccttctgtaagtggatatcactttgcataaccggtaacattgtcctgataccatcatcaacggaccaaggaatctgagaggcacttactgtcaattctgggtaatgtcgactgtaatactcaagaataaacttctcatacaatctgcacatacgctgctcatcaacaaacgaagccaatctacaatcaccggcgtcagtagtaataagcattccctcgataattaactggcagatactaatcaacatcctgtatgtttgattattacgttgaaatcttatcgatgaccatctgatggatgtcagttctaaaatatcaacattggagaaaaacaacatcttcttttttaggtcatctttgtactccgacttaacctttgcatttctcagaagcaaagaaactgttgttttgataatctggttaaacagattgttctcagacagctcatcaaaatcacaggtaagaactcgttcatgggacaagcgattctttatagtgccaggcatatttatctttccacgcattacatggagttcttcctgacgatttatgtactctcgatacaacccttgttttaactgaataccgattccttttgcaagaatagcggccaaaaggtcatacatctcgtcaaacgattcgaccgctacatcatcatagttctcctgttttaacgtctgaaaagcataggacagcatatgatatatgttatttattaatatgcttttatcctttgtcattgaaatacaccatgcaagatgttctcccaacgctgcagcttatcactctcatcaaaccagtactcactgagcataggtaaaatatcaaaatcgacaacatccttcatccattcttctgaacagtcatcagcattacagaaatagctgtgaccaatacagaatcctttaccgagcgacttgtcccgcattatttctttgttaagttcttttatgcgctcaataagtgtattgaatgtatcgtttgcaaatcctttctggtaattgatgaaaccttctgaatcaaaccccggttccatatcaaagaaactaaaacggcgtcttaacgcataatcaatcatagccaagcttctatcagcagtattcatcataccaatgatgtgcagcctcttcggaacagaaaaactcaatccgttataagcaagtgttacttttttgtcacgataatctgcttctatcaacataagcagttctccaaagattttactcatgttaccgcgattgatttcatcaataatgaagaagtaatctttatcaggatggtttgccgctttctgacagaatctatagaaaatcccatgcttaagttcaaagccttcattaactggtttatagcccatcatgaaatcttcatatgaataattctgatggaactgaacgaactcgatacggtcatcgtctacttcttccataatagaatatgctaatcgttttgcagcgaatgtcttaccaatacccggtgctccttgaagaataatattcttcttctttttcaataccgcagccaacctgtcgtacttagcttcggtcatatatacatcttttaagaaatcagcttttttatactcatattttcccttagaagatggcgccggattctcatcgcgaatcaattcaagaatgaattcgtactcacctttagtgagtttgaataaactgccttgcggattaatgaagtattccatcttttcaagctcagcacattccttaagcgtagcaaaatcaattggaaaagataggccttcgagcttttcaaaataaatcttctcaccatcctgctcagcgctaattctcattaaagcaacaacctgcttaaccggtgtggattcgtatccaatgaccatatcaccagctttggcatctatgaaattctgaaatatacgtctcttgtttccgttgtcgttatacaaagtataatcctgaacttcaccaacaggcatactcgccatactccacattttcggcttagcatttaggaaccaataacgaataccagatgaatcgttttttaagagttcctctttcgtaacatcaaaatatggttttaaaatataatcttcaaacagctgcatttcactttctggaacagaaatacaggtagaattatcattaggcgtccaccatttcttatggccggtatacgcacttgtatcgcatgattcagctattatggtatagcttctctcacaccagccatccttcttctcaggattttcatcaacctcatcagaatcaatacgtcccaacaatctgatgctgtttccacggcacaaatagaaaaagtccccctttttcattgtaaccataaagtcttcaccctgagatacttttgattttccttttgcagctgtacttttatgaacaactacaacccgttttttttcaaaagcagtagcttctgtttctgaaatacagtcattgccatgactaattttccagaaatgcggagccagatttgcataaagattgaccttggataaatcaattctctccaatgcttctgtaagttcatctctgagcttccaaacaaaagaaccttcttcgtcctttttcgcagttttaccaacgtacaaaacaggccaccatttactgttctcatcatcgccaagcattactggacatccagttttatgaactatccttctagcaagtgctgatgaacctgaattatagaaattcttactttcgccgtatttaattgctaactgtgtacaagaagcctttccaccataagcaagcatacgcttcataatttctaagctactgtcagtgaacacctcactatcgttaagcaaagcttcccagtcatctacagttagtgctggtgtatagtccaccggccaccactcatctgtagaaggcgcagagtcatacttgttcaaatgtctgctaataaagaatccaacatcaattgtaagcgttctgagctctgggtcaggataacaggttccggttatccgagaagcaagcataatcttcagttcattatcctgctgcaactcagcacagatttcattgtaaaatgccaagaagttacgaatgttatctgcataggcgccttttttgaaaatataatcgctctccagtacattggatactgctttgatttcactcaacttgtaaatgtaatacttgtcaggatagcgtaaccagagatatgtgcatatagcgttttcgtgctgataatgctgaccagcgccattaccgtatctttcaagaaggctgttagatttctgcttgaagctatcaatacggtcatatacatctttgctctcatcaaaaagctcgatgaacatagctctaacttcttcccgcgcaatctctgcaaatttagtaatcatttttgcagggaagttattcactgatgcaagaaggtttcctgtctgagataaagcttttgtcagcattccagcaaaattatcggaattcacatcccaattaacctgaaagcactttactgcttcccatttatacttttcatccggccactgcgtctgaacaaaacattttttgtattcaacaagcgcagcctttaatcgaaatttgtctaacattattattcaccaccttactttgcatcacatagactcttgtatattttatcagagaagataccaagcacctaatacgtttttactggttgttttacttgattatcacttgaactctgcttgattttatcaacatatcacaactctgaaataatggctggtactaaagtttttaatatttctttttcaaattctcccatctaaacttctccttttatcatttcaaatatttttaatcaaatgtccaaaacctctaactaggtacaatttttattaaagtataactatgaaaaaccaacctgctacctgaaatataatccgctctagtttaagagagcattttctttatactttattaaaggtaaggctgcataatttacgtttgcccaaaagtaaaagtattgtggtatagttcattttgcgactgtataattttaaagtaatattcacacggcgttaccccattcccctatctgcgaaaacttatccatctcaccttccgcaaaaacacaactctatttccaccagacaatccctgcagccccgcctaaaatcaaggtttacgcacgagaagcacggcggtttccatttgtgttgagtgtgtaataatgatggcaaaaagatactattcacccttggcggatcagtaataccgaccgtaggaatgttcgttatttccactcaagatttcaataagcctttctaaaatttgtgaataatctaactgcaaatacacaaaccttttgcccttctatagcgcgttaccagctatattgctttctatgaaaacacaatccctgtccccccatcgtctcacaaattgaggataggatccctctcttgtagaatcaaaccacaattccaagtctctgtcgtaaaaacaatacattacttcaccttctccatatgtggaataggcacctgcttcctttgcaatttttagccgttttcttaatgcaaccaacatatcacagattgtatccagattctccctccactccggatttacaacagccgatttcccttctgacttctttaagatacctccatcccttgccctaagaacacccgtattcaatgcaatgatagtatcttcaatagccttgtcaaaatcttccactctcccttcttggcatattctattgtggaacgctggtctatcaaagcattgtataaaaaactttacaaattctttatttccatccgttttacttgctaccgcttcctccagatcaagaactgctaactgttccgtgagttctttccatttcttcagtttttcaatcgaatacctttttacatctgaatctattgacttagggcaagattaacataaccatattccgttttcaaaagactttcttgagctgtcatgttttcatcatatcttaggccaccttcagaagcagctgtaatatgagctgcaactcctatatttataacatccgttttctcgacacctgcgccacgtgttgcttttatacaatttggattactacatttccatccaactctatttgccaataattctttgtagcttgtgaaaattcatctctcatatactttcctcaatacatattaaaataaaacatctatcagttacaatcagacaactaacggtttttccatatatccgcttttatgcatttcttcgtacgtgttaataatatcattcttttttactaaatccagcgcttcttgatattccatgcctaacatgagaatattcattctaacagcatgcaaataattttcataccaagcccattcggcattttgagataactctcgaattgttgaacgagatacaataggatttatataatagttgtcgggttgacaaaaactctttaaaatatttatgttattctccattactcttgtctgccctattacggaaccgccaatttcattccatggaggaaaatggccgtattttttatgaaaggcttcaatcaaaatcccctccaccattttaatatcttcttttccttgctcacttaacagatcctctactggagagttactttgttttgcaaatgcctcatacatatccttatttctatgcactaatggctgagataaaggggactggacaaatattgtatatcctaaccgctcattcttagaaaaatactcctctatttgtttctgtttagatccttgcttaattggcagtattccattatgctgtttaaatctttctgccagatctccagctaaaccaatatatagtattgcttccgcataataatcccaaaaacaatagattcctgctgacgcccaaccataagtatcattcggtgaacacaaatcatcaattgcattcgccatttccatagcttcatcttttctataagcatctataatcacagttccaaacataaccttcctttcacactccccctcatattctactatctattttcaaggtttctccgacattttatgacattaatcttaatacttatgggcaaataaaatcaatgtcaaaaaatcaagaacttttcttcaccaaacttccattttactttatgtgtatgtactactatttttttaccaggtaaaagaaaatataaaggcctctctgtcctcacgtctgaaattcttacattatttctgttatcctgctttttctcttatattatctccatgcaaaacaatttaaaataacattcactgcccaacgcgctacaacaggataatggtttcgcagttagttaaagatgtgattcggatacctaaacgtttgaattgggttttaacggaacggttatccatacttccaacatagccatactaccttttcaaagcctaaacttcatctttttttgattagaatggaggtctccgttcatagcacgccgtagcaaaactacgagcctaattggtcaactgacatccccttgataaaaaagctgtcctgtttctcatctatgtagttcttcccatttatcacagaagtaacttggatacttttccaattccaatcgtattttttcattcagtcccttattttttcttatcaacctaatcaattcctttctgttaccaggctggtacacctcctccaacatgttacctactttcatagcgataccccgatcattaaatcccatctcatataaaagaatacttgtttgtccagctaatccgtatctcattcttttagatagcatttttaaaatattatttattctattgtcatcccccaaatacatcacattttctataatagcagcaagtatgagcgtacaatcatatccaaggaagttatcacaaaaagtaataacatcttgcagagacatgattttggggtgtttacgtttatataccattattctatgttctgtaacgtattctgtcaaatctgaatatgtctttcctgcaatccactcttctgcaagcccattcagtaattcactattaatacaatttcttactatctgattttctgttctgagtaacaacggaaaaaccacttgcattatacttttctcattttcagcctccaggattatcgaataatttgatgaaacccactgttcaatttcaatttcttttcttactcccagaagcgacttgctgtatctgcttcttttatctacagtgtccactgcatgtactagaaattctccaattaaatctacaatccgtaaaagccgaattctctctttgttgccagcaagataaaatgcaagtgtttccttcataatattgtggatatcttcacgcgattcttcataggtatcctccatcagatagaatagcaaaaagctttcaattgcttcgatattttgtttcatctgatacatcatgaattctgcctttttatgattttcctcctcaaattgttgttccttcaggtattgctccatcttttcattgaaatccccatttgcataactctccatgaatatttctatcatcttctctaaatatacttccattccctcgtctgcacgcagccacgcgaataaggtactagtacacgcttcggcctgatcactgtctaaaagccgtttgtagttattccatctccagttataatatggattatttctggtattatacacatttgtctctgacagaataattgttccctctgtatagatacctgcccttccagctcttcctatcaaattttgaaaatcacgtacccgaatgcggtcttttccctgataaatattcgaaacaataagataacgaataggaagatttactccttgtgccaatgttgaggtacatgcaagaaaactgatttttccagtctgcattgcatattctactgcacatctaattcccatgggcatacccccgtgatgtacaaatgcccctaccttagctgccttatagtagtcattatcatttcctaaacccttgtcaatcaggcaacataacttatctatttctgtcttatctgcactctctaaaagatttgaaacattaattcctctttcctttatttccagtatacgacttaatattttttccgcagtatctttttttccgcaaaaaatagcaatggaaccattgtgacatagttttattccaaatgctattgccacatcgtttttatatttattatcatttacctctgggaaaactctcacttttctttctcttggacgtaaataaagcatagtctgcttaattacccttggaacaaaaaaatcttcttcatctggttcagccggatttacaaaataaagatacgcataacgttctccagatgtagtattttttttcatatctgccattgctacaaccttctctgtggtctgaataatattattttttattacaaccccccgttcatctgtcagccatccatttacctgctctgcatttggtatgaccgcagaaatcagaattttttgcactttatctttcatgtatgacttgattgtagaaatcaagagctcataagttattccacgattattatcgtcaaataaatgcccctcatcaaaaataatcaagtcaatgttcgatagaaacatgatctcctgccgcaagacaaacaataatttttctggagtaactatataaacatacttttcttctgtttctggtacattaccaagtattatatccagcatgtccatctgcattacatccgaaatttcattaacatgtattttgctagtgtaagaaaatgccctttgtagctcatcggttatttcacggcatagagagcgaaagggggccactacgagagcataacttgagtttttccttagaaatgcagataaaataatcagtgcaactgactttgtttttccagaacttgtaggcatctgaatagttgctgactttccagcgaatacaccagcctcacccaattgtctctgagactgccataattctgatatcagtgttttctttctcaaaatatctccccagatttctggatcaatctgtgtataaataggcatcaagcgataagatgagtgttctattttcaagaagatagttgcaattaacgcatctgtaaataaaagttccctatctgtaccatacttgtaaataaactttttaagttgccacaactttttataatcaaacactatacctgtagaccaaaattcattataagcattcacaacctcattcagatacaacatttcagaaaagcactctatacaaagttttccctgtaatatctgtgatagtacaaagtcaattccatttgcatcaagattaatatcatcactaattttatctgcaaggactttagaacttccgttatagtcacacaaataataaaccactgctcccaacaaaagatagtatttttgatctccctcgtacatctttgcttcaagataagcatcaaaaaatacggaagcaaattgaagatttttcttgtgctcggtataatcgatttccttggtttggtaactttcaatgacatcttttgaaaaatctccaattgttgcaattgcaagaattagcaggtaatttgcatcactttctgtcttcccatgtaactcagaaggtatatggtattcatacatctttgccttagcacgaacctttttcaacagatattgcgatctattttctatcagcataaagccgccctcctatataactcgttgattaatccttttaaatcctgcgtatgtatcacaagcagttccactgttgccttatgcccaaccgttgttactttgttcatatctatggcattatatttttgatttgtaagaacggcagatgctccatattttattacatagggtctatctgtcatattttgaaaacgagccacaatagatgcttcctctggtctatttaattctattaatctcattttagctgcatttaaagattcagcatatctagccacatctttattggaatgatcaatagcctcctgcaacctttcatacccttttttctttccttttggatcagacgtgcctttcacttcaaatataatcgcttcatctcttggcgatggtgttgttcctaatttaaaccctaacacatcactgccttgtggtgatgtgttccgattaaatttactacggtatcggattctgggtacataataactctgaatatattcgatataatctgccacaagaatctcacaaaaatctcctacacgagttgcgggtcccggctttgcttgtcccgggaaaacataatctcttaagaattcttccctgcttatccccgttccttctctttccatatccagagcatctaggtaacgatactgttcccgaaaatgagctgcccactcatcaagcactgcatcattctccgatacctcaaggcaacgaacctgtatttcctttccgtcttttgtcagcaaactttgctcttctcgatacccattaatgtactccatctataatcacccttctcttgaacatcatctcaattaccgaaattagataaatttcttctcaaattattataaatactacttattcataaaatcatgtcttaaacataatacctatatttcatgccttgtaaatatctaaagcagatctcccttgtttaccttttccctaattaaatccaccatcgtttagtactcatacagtcagaaactataataacagtgctgatactatggtttctagctaaatggcgcactaggttagcacaatatttcagggacatctattcggcaaacacaatattggtaaaaacgctaaaattaatcaacctatatcagccaaatctcctatataaaatagtatcatactcccctcgctattaccatctaaaagatttctgcatttctgtttatttatccctatgcaaaataacattctcaactatctattataattcacatatctgatatccctctttttcagcataacaaattatcaaccgcttctcataaacatctattctcttcactctgtcttttacgacattttcatcatattccccattacatacaacttttcccagcatctctcttacatcttgatcgttcaaggtaggtgaatttttacactccgcctttcctttttccacccttgtcccacatctccacacaatcttcccacgctccgttctacgcctgaatcctcccccacaattcccgcataccaataaattactaagcaaatatttgctgctatatcggttaccactgctaatctgattgccgtcagctgttctgagcagtctggctctattaagcatttctgcctgcactttatcaaatatttccgaagaaataatggccagatgacttcctttcacataatatctggtacgctgtcctacatttttctttcgtataccatttagataatcctctgtaaatgttttctgaagcatcatgtctcccttatatttctcattctttagcatttgttgtattacatttgcactccatacctctttacctgtaagcattttataccattatcttccagatattttttaatctgtgaaaatgtgtattccctcaaatataactcaaaaattaatcgtactactttagcctgctccgaaacgattaccaattccccttccacacaccgataccccataaaatgtttatagctgctaaataatccttcctcaaatcttctttgaatcccccactgaatattctcactcaaatttctgctttcttcttgtcccattgctcctgataaggttattgccgcttctgcatccggatcaaacgaattcacattttcaatttcaaaatacatttgaatacccctttctttcaaatatctcataatctgcaatagctctaccgtatttctggatactcgttttgcagatttagtgattatgtaatcgaatttcccctctgtagcactttctaacatacgttttaatccattgcggccctttttccttaatccactacttccacaatcccagaatactcctgaaaatactcaacccggatgatctgatatctgttctgtatatgccacaatttgatgagccaaactggctaactgcgtctctttcttagtgctgacgcggcaatatgccgccacacgcagcggttccatattctcttttttcacaggcatataatatatatttttcaaaacacatcacctcgtttcatcaataaggaaaaggcgcgaaagccaaaagccttcacgcctcaccacacggcaactatccaatctcacctaatcatcatttaacactcttttgcaacaggacaatactttccacatgcaccgtccccggaaacatatccaccaaccaagcctcctccgcccgataccccagcttcttcatataccttacatccctggccagcgtctccggattacacgacacatacaccaccttctcggctcccagcttccctacggcgtccataaactcctccgtacttccgcttctgggagggtccatgataaccacatccgctttctcaccctgttcagccatattcaccagaaaacgtcctgcatcattgcaataaaagcggatattctcaattccgttcatcttcgcattattaacagcatccctgactgcatcctgattcagttccacgccaataaccttcccggccgtcttacttgctataatcccaatggttccgataccgcaatacgcatccaccaccagttcctgcccggtaagaccggccagtgacaatgccttttcataaaggatttccgtctgcacaggatttacctgataaaatgactttgatgatatacggaaccggcatccgcacagctcgtccacaatatatcccttgccatacagcacatgctccttatcccccagaaccatgcttgttcctcttccgttaatattctggacgatggtggtaatttccggatgtttctcccgcaaagccttaacaaaattattcttagacggaaacaccggagatgctgtaaccaacactaccataatttcccctgtggaaaaacccttgcggattataacatgtctgagaagcccaaagcccgtatcctcatcataggtcctgattttaaaagatttgagcattccgcgtatagtaccgatgatttcatctgctttctggtcctctataaggcacttctccacaggaactacatggtgtgtattttcttcatatattccggaaatgatatttcctcttttgtccctgtcaaatacagcatgtaccttattgcggtaatgaaagggatccttcatgcctataataggctttacaggacagagtccttttagcagttcttccgcctgcttctgtttgaacgccagctgcttggcgtactccatatccagcagctggcagcctccgcacagattcagcaccgggcagatactgttgctccgtctgcttccccgtcccccatatgagcctcctcttttggaatcctcactccgcctttcagcattaagagcccctccattttgttttttagagactgacaatccatccgcccctttgcgtacccttggtgagctgccatccctgcgtttttctccactgcgctgcctggaaaatgcgccctcattcccatcaaaccgtttcccgctctcacctgcaccgtttttaccttctccgtccctcaccttgtgtttactgtctttcatgttgtctctcattctgtccttcacgttgtctctcaccctgtctttcactccgtccttcacgttgtctctcaccctgtctttcactccgtccctcacgttgtctctcaccctgtctttcactccgcccttcacgttgtctctcaccctgcctctcactccgcccttatctccctttacgcctttcctgcttcctgtacccgaatctatccccactcttttaaccgtctttccagccattttaccggacattcctctatccgctcttttatccatctttctatctcctcgtattcatccataattttatgcgcctacagcaaattcaaagttactgtcaacttcattcaaacatacttaaccttctctaaatcaaaatccatatggccattctaccatatatttcccctaatgtataaccatataaaccgaataaattacatcctaaaaaacacatctccctgctgtcaataacaggataacataaaattttgccatacctgttataaatgccctgtccccacatccccatccgccccgccacaaatccacaccctttcccgcaaaaaagaccggatatttcccgcagcactgctctgcattctgcaatgccgcgggattacccagccttttcatccatttactatctttatctgtccagcctttttccaatccggacatcatcaaccgctcctgctttatctcaaggcttctccccgcttctcaatcctcctcatctctcaaactgctctcgtagcctccgccagccacactctctcatcctcatccagataagggctaatcttctcatacacctgctcatggtaccggttcagtagctccacatcccgctcagacataatctccctgtcaattacctccaagtcaatgggaacgtacgtcagatactcaaaccgcaggaactggccgtattcattcttctcatcctcaacacacaaaaccagattctcggtcctgattccatggcttccctcaatatacacaccaggttcatccgatgtaatcatacccgcttccatcaccgcattgtcctggcgctccgggaccattttgaagcggattccattgggacgttcatgtacactggacaggtagctcaccccatgtccggtaccgtgttcatagttaagcccccgtctccacagcggctctctggccgcataatcaaggctgagtccgcggcagccatgaagaaacttcacatctcccagacgcagcatactcataagcaccaaggtaaaatgttccttttcctcatcagtcacaggccccatggcaatggttctggtaatgtcggtggtcccttcataatactggccgccggaatcaatgaggtacagccccctgggctccagagggatgctgctctccggtgtggcggagtaatggcacatggctccatgtgctccatatgcggatatggttgcaaagctcaggccaatgcatccctcctggtccatgcgcagcttcccaagataatccgacacgctgatttcgtccatgggaatacgccccgtattcttcttcagccagtaaataaacttggtcattgccacgccgtccttgatgtgggcccgcttttcattctctatctccacatcatttttaaccgccttcatggaagcagtgggattcatcctgtcgatcaccttattggacccgtcaatcaggcggtatacagcatagttgacacggcatttctccagcaggactttctcgtttttaagcccctccaccatgtcgtataccccgtcataaggcatcactgtgacgcccgtccgttccagatactccctcacgcttatgccctttgcatcctccagatacggataagcttttccttccagcacactgctgttgacaaacagatacagttggtccatggtcaccagagcgtacgacagcaccacgggattatacaggatgtcattgcctctgatatttaacagccacgctatatcatccagggaggtaagcacgtgaacagatgcatgtaccttttccatagcctccctcacatctgcgatcttatccaatgcgctctttcccgcatacctctcatccagaacccatgcaggttccgccgacagctcaggccgttcctgccatatcatgcctgccaggtcttccccgtaggaaatacgcgctccccgctccctaagcatttcctccaaagcaagcccttcagccgcattgactacccggccgtcaaatcccaggcatccgccctcaggcatcttatcttccagatatgctcccagtgaagggacgccctcctgccccattttcatcatggtcactgtggaatcctttaactgggccgctgcctgcacatagtaacgcccgtctacccaaaggcatgcttcgtccattgtaatcagagccgtaccggccgagccggtaaatccggtcatatattccctgcatttgaaatgctctcccacatattcggattcgtggaaatctgccgtgggtatcatatacgcatccatgccccgctccttcatcaatttccgcaatgcatccaatctgtcccgaatcacattcataacatttccatccttccgtttcattctatcctttccctctaacccctttccttctaaccccttttcttctaatccctattccactacctctattccactccccctgtctcgccaatccctatcccacaaatccctctatctcaaatccccaacttatcatctgtctccctgcacttatttcttcctcatggcatcttctatggccgctccaataccttcattgtacgtaggctgtgcccgcatggcaaaagacatttcctctgcgctcagtccgttggctatggccgtggctatttccccaatcatatccgtagctctggggcacatcatctgtgctcccacgatggtatttgaatatgcctcaaataccagacggataaatccattttcccctccggttataatggattttccattttccctcatggaaaaatgaccgcagcgcaccttcagccccttttccctggcaatttcctccgtgatgccgacagtggcaatctccgggtccgtatagatacagtttggcacaatcggaagggacacatacataccgttaggcactacctccagcttaatgctgtggggccttccggcaatcttttccaccacatatgtaccctgggccgctgccacgtgggccagctgtgtcctggcggacacatccccgatggcgtagattccccgctcgcttgtctcaaaatcgctgtttacggcaatcttcccgccttccatctccagagaaatatccttgcctaaaagcttctccacattgggccggcgtccgatggccatgagtatctggcctgccctcattttgatgggttctccctccccgttgggagtgatgacgcagcttagcccgccctcttcctccaatatctcagtaaccgtggcatcgcagtatacgtcaatgcccttttggcgcagctctttttccagctccgcggacatcacatcatccataggcgccatcagatgcttctgcttctccacaatcgtcacatgggaacacaggttgttgaacatggtggcaaactccaccgcgataacgcctccgcccatgattgtcagcctgtcaaaattccagctctcagctgccagcagcctgtcgctgttccatacgcccgtaaggtccgcgccgggaatccggctcatgtagggcactgcgcctgtagctataatgacagcatttccgcggaagaattcgcggccgccttcctttagctccacctccacggtcctgtccctgcgaagcaccgctgttccgtaaacaatttccacattcagcttctcaaagccgtacttaatgccgtccctgtatttgaccaccgcacttttcttatacttctgcattttcccaaaatcaaaggaaataaaatccgtggacacgccaaattcatcgcagctctgcatcatatgaaacatatcagaggcgtgaagcagcgccttggttggaatgcatcctctgtttacgcatgtgcctccaatcttctttgcctctatcaccacaaccttaaggccaaattccgctgctttaagcgctgccgtatagccccctggcccggctcctataatcactacgtcaaattctcttgccatacccgttctcccttatgttcttgtaaattattcttttaaattatcatgattacattatatttcaattaatttcttccaagcatttcttcaaagaaggcaagcctaaatcagccccaaatgcctgcatgccttccataccccgtcccggtcaatatcatctgccacgtaatccgccacagccttaagctcctccacggaattgcccatggcaatgccgatgcctgcctcacggacaatctcatagtcattcatgctgtctccaaaggccactgtctgctccaggccaatgtcatagtactggcacagccgtttcagcccctctgccttggaagcctcctgctccaccacatccgcccccatgttcccggagaacataggaaatttgaattcaggaaaatgggcttccagctccctggcgccttccggaccgcctatgtaaaccaatgttctcaccggcatatccaacaattcccatccatccatgaaattgcgctccgaaacaccccagcgaagccggtccatgcggaccacgccctccgggtggatataataatcctttccctcctggctgacgcccagggaaattccgtgggcatccccgtattccagcaatgcccggagcctttccttgtccatcagatgttcaaacaggacatttccctcagccacaacccgcgtaccgttcatgtgtatcaccgcgtccggcataatcatatcccggtataccacactcatatcatggtccatgtttctgccgcttcctatggcaatgaccgagtccttccgcagcagttccagtgctttcatggcgctgtccggaattttccaggtcttatggtccagcagtgtcatatccaaatcaaagctgacaatccgctttttcttacttggtttctgtgtcatttttaaattctccgaataaattaaaattaggtcttttcaaaatgaaaattatctgatataataattgaggttcgagaacggagtatggcgtagcttggtagcgcgctcggctgggggccgagaggtcgcaggttcaaatcctgttactccgattcacttgttatatgtcagaatctttatcttataaggattctggcatttttttgtaccctgtacccgcaggcttccatctgaatccaaactatatcttaagaatatcctcacccaaactccgagcaaaacatttccatatacatccggtgcacaaattcctgcgcaatcctctgaaaaagagcccttttgtcccggcgtactgccatacagcgttttctttcatcaaagtgattaacagcagcaccgtgtcccgattgattataccacgttctgctaaattattccatccattttctatgtgcgtgagcgttgactcctgcgctgattcctgcgctgacttttcataatcagggaataagcatgaccgttgaaggatccggcttattactgccccggaaatggaaatgaatacacaggaggtaatcaaaacacaggaggatactatcagaattccgataaaacacaacgacgaaccaaaaaagatacaagatatgatttttaagccttgacagaataacaaatatatgaactttttttcaagcatgccggccctctcaatggatggacacagctcaaaagaaaatcagataatggggaaatgtgctgcctgactcagcagaaacaaatccattccctctaaacagaatcagagctgccgcagctcaacatcatgccgcagcagctctgattccgctatattatgcatttattatgcattcccttaatcagctatcctttttacccttcgcgtcagcaacccgctcagccaatcctctctctggatcacaaacacagacaccaggataagaagcatccctcccaccttagccatggtaatctcctcggacaggagcagggcgcttaagaggattcccaccaccggattgatgtacgcatacgtggaaacaacagaagttttccacctgcgcagcagatacagataggaggtcaatcctacaatggaatctgcaattcccatatatgccatgggaagggcgccgcgccacgataacttccccaggtcaaaatttccggtcaaaactgcacagaaaaaaaacaggattgcgggaatcgcggactggtaaaaaatctgcacctgtacggaggcgctaattgactgatatttcagatagacggttcccaccgaccacacgatatcagcaagcagcagcagcgcgattccaatagggtcagcgtttccgccggaaatactgcccaccaccaccacagcgataccggcaaaccctccgataatccccccaatccccacccagctgacgcatagtttacgggcggcaagggagtccaccagcaaaatcgtaatgggaatcaggctgaccatgaccgtgcttattcccgcatccacacgccgggaggcgaataaaagcagcaccgtgttcagaaaatacataaggacacttcccactgccagggtctttccgtcacgtaagccgacagcaagggactcatgccgaaagcccacccacagcgccatcaatacagacgcaatcagaaaacgcaggctgccggcaaaaaacggatgaatcatgctggaggacagcttatttgccacgccggccgtcccccagaaaaagcagatgttaaaataggcggcaaagggaagcagcctgcgcagagaagaatcgcttttcatatttgttccctctaaaaccgccgaaagaaccgctaggtcgtccaccccatgggtgtcatcacgcagaaaccgattgcaggtgtttcacctgtatttatggttctgtgaggcatgttgggcctcaccaccagtgaatcaccggcattcagatgataagttgtctctcccagtaccatatcggcttccccctgcagcagaatgacaatttcctcagatgggtgagtcaaaaattcttcggagtcatggccgcccggttcaatctgaaattgaatcaccatggatgacggtgtgtattccggtgctgacatcggagaaacaatctcgtaaaatatctcacttttgggaaacttgataattggtctctggtcgctctttaccatggcaggatgatgttccgactggtccaccagcaaatacggtgaaacccccagaaactcactcactttgcggagagaggccagggacggttcaaccgctccgcgttccaactgggaaatatatccaatggaaagtcctgtggcctctgcaatatccttcagcgtcagttttttttcttttcttaattttctaattttttctccaaccataatgcaacctctactagaattcgttgagcgacggcaattccccaaggacctgttatacaaacaagcattgtcccatagtaaatgcgtctttcacaggccaggacagacaacgcctccacatgccatagcttatcttaccatatttccgaaaactccgacagtatctgactgcaaattttagcaaaaaggattatcgctggagtcacgttcttcttttcaaacgaaaaacggagctaaaaatcatattcccattaaaacagctgctgacaaaatcagtgcctgtgcaatatataggatgccgaacaacggcatgaaaaacttccaccacttgtgcattggaattccgctgataccgatggaaatggcaagggaacatgtgggccacagaatattggagaaaccgtcgccgaactggaatgcaaggcaggttacctgccggctgactcccagcagatctcccagaggcgccagaatcggaatcacagtggcagcctgtccggtggaggatggaataaagaagttaatcagtgtctgcagaatcagcattccctgagccgcaataatcggcggcattccctgaagcacctgggaggcgtaaaacacgattgtatcaataatcatggcgccctgaaggataaccaggattgcctttgcaaagcccacaaccagagcccccatcacaaccgaggacgcaccttcaagaaattcttcagccattttgcttggtccccatccgctgacagcgcctgcaaatacgcccatcagcacaaagataccagccagttccgcgttgccccatcctaatttcagagagccgtaaaaaatggcaaccagggatacgaggatttccagaagaatccacatctgctttttcgtggtctttgtgtttatgatttcctcacggttaaagttaatatccagcttatccccaagaatcagactcttagatggatttttgcttactttctgtccatagtagaaaatataagcaattcccagtgtgctgaaaatcacaaaggataccacacggattcccattcccgaaaagatgggaactcctgcgattccctgtgatacgggtactgaaaacggattgagcgtggcggcagaccagccaattcccttgcccagctccagtatggcaaatccagccagggcatcatagcccagcgccacaccaagccccataaacacgggtatcaatccattatactcattccacataccaaaggttgaagaaagtacagcaaatgtcaggaagaaaaccgggattaccagctttgccctggacgaaaatctccgcagcagcgaaccgagaaatgcgttaaatgcgccggttttaagcaccatgctaaacgcaccgttaacaaggaatatcagcatggttacttccgcaccgctgacaaggcccctgtggagagaactgagaatggtcaccagtccggccggatgtttttcctcaagggtgtggaaggtgccgggaataaccagtgtgcggcttactccctccacttccactgtctgggtatcaaactggcccggcggaacaaaccaggtacagactgccacaaacagaatgatagcgcagataataacatagacatgcggtattttaatgggcttgcgtgctatggccgcagttccgccattggtgtgtacatttttattcttttgcatatacattgctccttaatcgaacatattcgttgtgatgtgtcagttccaattcgccctcagtacgcgcagcagatttttgccggtcagttttgcaatatcttcctctgagtaaccacgccgtttcatttcatcaatcacgttttccagctgccagcagccttcaaaccctttggcatggcgttcatccgaccgggtgcccacacagctgttatacgctcctaccactgccggataaagcacagcctggtctgcggttcccttgtcatccttattaccatccagggtattgtcagcgccgaacgacacatggtcaatcccaataagatttaccacataatccacatggtctacataatctcgcacatccggacggcagcccttctcttttttccaaatcaggggagcccagggtgaaattcccatgacaccgccgttttccttgatagcaagcatttcctcatcggttttggttcgtacgctgggtgtgatgttataaacaccggcatgggtaatcgccacaggcttttcacttaggcggataatatccattgtggtctttttgcccacatgagacagatcggccagcatgcccagacggttcatcatcttaaggacccgtttgccaaagtcagtcagtccgccgtcctgagactcgcagcagcccgtgcctatgaagttagcatcattataagtcatctggatcacccgcactcccaattcataaaaaacgcggagctgctccagtgaattctctatggagttaggattctggaacgctaaaataagagccttttttccatcttcctttgctttataaatatcggctacagactttgcaatcatgaggccatatttcgggttgtccagcatattgtatatcttaccaatactcctggtgctggcaacatacccatccccctccccgggaatggtcagaaaaaacgcgtccattttagaatgcagtacatcctcggtgacacctgtaaattcggtctcggtaaacgcgcaaccatcaatgattaaatcttccttcattttttacctccactaaaattttatttaacaaaagaataatttggttttgtttgcaacctcatataggcttttgttcatgccataagagtatcatatatacatgttatttacaagacagttcttccatataatcacaaattctatgactatatcaattttttattgtatattttgtatacttttcacaagaattgttttttaaaggctctctccttgactttataccgccttgaatataaaatgaaataaaattatagtataatttcaaaattggaggggttattatgagccaagctattcaaaaacgtatcgcatatattggcgcaggccagatgtgtgaagcaatttttagtggtcttatcagttccggttccattttgccggagcatatcctgttgtatgatgtaaacgaatcacggcttacagacctgcaaagccgttaccgcacaaacatcctaacaccttccgcccatgcctatgaagatttggtatcatgggcagatattgtgtttttgtccgtacgcccccaggatgccagagaaacactctctaaagcaggcatgctcttccggccggatcagactgtaatctcaatcatgggcggggtgaagctctcctttctggaggagtatatcaaaaacgcggcagtggtacgggtaatgcccaatacacctatgctggtaatggaaggagccgcaggaattgccctgggcgcccgctgtacttcccaaacagaggagttggtaacctcaatttttaatgttattggaagcagctatgtattgccggaatcactaatcgacccattgaccggaatcagcgggtgcggtcctgcatttgcatatctctttattgaagccctggctgacggcggtgtggagatgggactcaaccgtgacgcggcactaagcctggcagcccagtgtctcatcggagccggaaaaatggtattaaagacaaatacacatcccggtattctcaaagaccgggtatgttcccccggaggcggcacaatagccggcgtacataccctggaagaaggaaaattccgcggtgttgtgatggatgccgtggtgcagagcatccggcggatgcagaatgtgggtgataaagcgtaagagcagaactaccctcctgacttatccacaatcattctcccctcaattcagttatacacagtaccagacctggtattttcagacgattcacataaaatatctagtgttttcggtggataatgtggataactttgtggatatcctgttaatcttctgttgattccatgtggatgttcttttgcccacacgctaagagggccgtacaccttgggttcggtgtacggccctccttcttattccagcaaatcctcataagatgttcccagcgctgctttgatggctttcagctgagaaacctttatatgctgcgtccctttttcaattttcaccaatgcctctcttgtaatgtctgcccccatcagctgcaggatacggaccaggtccgtctggccgatgtcggattccagcctgattctgcgtatgttggcgccaacattggttccttcatcattttttatcacatccattacccttctcccgtacgcatgattccattccataaactcacttcatgaacccatttcagtccatttcacccttcatattatggagattttatgttataatgggaccaaaaccagtccatcatttaaagaattcaatgaggtgaccctatggaacagtatgactttacagacaccggcaatgccaaagatatctacggattactggattgcatgtcggaaaaggaactggagatggccagggaggcggtccgaaacatccgtgaaaccgcgcagctggcccaattcgagcggtacaatgcgtggttcgaccacacccttcttcccatcttcaaggaatatgcccagatgacctcttccctgctgcagattgagcgggataacgggaccatcgacgtcctattccgcaacagcggcggtctggacatcacagagaactgtaaggggatgtatatggcgctcatgatagctgtacatatattcatggattcagacgccggagacgcggttctggccctgacctatgactgctgcaggattgtatcatgaaatgatgcctgctcatcctgccgcccggccaccatccgctccatatccgccttaaagcactgcactggatactgatacccctcatatccagccatccggcagcgttcccggttcacctcatgacagtggaccggctggaacagctgccccttctttaccagggccgggattttccacagacagttgtccatctggttaagcccggccacagaacgcctgccatgggtctttgtgccccggatccccctgcctgctccagataggcatggatttcctccctgccgtattcctccgactccatggcctgctccagcccttccagaaaatgctcccggtaatatttccatgcactgccgtccattccgcaaagcaccactgcaaaacggttgccggcattgaccgccgcctactgcaacagctcatcataggtcgtctccagtatgaccttgatggcctttagctgggacaccttgatatgctggatgccccgctctatttttaccagtgcctccctggtgagattcacctcaaagtcccactcttccaggtcaatcttctgaatcagctctgtctgtccaatccctttttccttgcggattcttcggatattggtccctatattcgtattctcatcatttttaattatatccattcttccaccctgaatatctggactgattttagtcctttttgctcttaatcttattcaaattttatgatataatgggaccagtatcagtccaaatggaggtcaacccgctatgccgctttgcttttttgcctgtgatgacacatctgtcctttactgtaatgatgactgcctgaaatttttccgggagcaggctcccgggacggaatcacctgcggcagcccaaaaggccgcaagccgctttccgggataccaggtatttccccttggaccatacacctgctgcatgtttgcatttccccggaccgcctctgcctccgggttttcccagggtaatgacaggctgcctgtaatatatgaatccgtgctcaacgaggtggaggagggagttgtcatatcagaccatgagaacagggtcatattcatcaaccgcgccgcagaggccattgaaggcgtggatgcccggatgtccctgggcaaacgcatggaggagctctatctccctgtgggaaacggaaaaaagaagaacagccatgccgctgtcctcaacacaggcattgcccccaacgaacatttgaaccaatatgttgtaaaatcatcacacaagataatgaatgtggtggaacgcatgtacccggtcaatatccatggccgcaccatggctgtgttctccctgattaagaacctgccagtcatacagaagtccatggaacagggcctggagctctatgattatttcagggaaaacactccccccaacggtacccgctataccttccgaagcattgtgggcagcgatatacggtttgtggaggcaatctcggacgccaagtgcgtagcacggaaccagaccaccgtgctcatatacggagagacagggaccggaaaggaattatttgcccagagcattcacaacgcaagcccctatcagaacggcccctttatctcggtcaactgcgccgccataccttccaccttgttggaaagtatgtttttcggcacggtaaaaggctcctatacaggtgccgccaacaccaccggactctttgaacaggcccgaaacggcactctgttcctggatgaaatcaacagcatggacatctccctgcaggcaaagctcttaaaggtcatagaaaataaaaccgtgcggcgtatcggagacatgaaggagcgggaaatccggtgccgtattctctgcgccttaaacgaagcccccctggcatgtatagagaacggaaagctgcgccgggacctgtattaccgcctgtcctcctgtattctgtatataccacccctgcgggaacgaaaaagtgacattcctctgctgtgcagctattttctcaagcatttcaatgaggaatacggccgtcatatccacaggatagatcctgaactgatggatcgttttctggaatacccctggcccggaaatgtccgtgaactccagcatgtggtggaaagcgcattctctgtctcccgaaaggatatggagattttgcagctaggtcatctctcccactattacagggatttttttactgccagcaaaccggaagctgtttccggcagccaggccgccccaggccccgtttctccccgcagcccccagcccctgaaagcctacatggattcctgtgagaagaatttcctggcagcggccctgtgcagccacaacaacaatatcacggcaaccgcccgctccctccagattaccaggcaggcgctccagcacaaaatcaggaaatatggattatagcgtataatatcctggcagtgacaattttatttgcgccaaaattatttacaggttcctcctgatttacctgttttatccatgttccgccccaaaagcacccttttatcctcataaaagcgttcttttaccgatgtccctcattctggcatataatttgcttttaatattactgtacatgtacagaagggggaactgcggacctgcatcctgcagcctgcacaattcccgaaattttataaaataagggggactgaaaatggaaaacaagaaactgaccatgagggaaatgatctgctacggtatcggagacatcaccgccaacgtgtatcttcagttcatcgccctgtttgccatcgtgttctacacagatgtgctgggtatctccgccaccctggccggcctgattttcatgggaagccgggtctttgacggcatcaacgacattgcggtgggttacatctctgaccggtacggtcactataagcgctggattctatacggctctatcgccacggccgtggcctttgtcatcatgttcacgaattttcatctgagcacgaaaatgcagtctgtatacgccctggccgctttctgcttctggactttgatgtatacgtgctacgcgattccttttaacgcctttgcgtctaccatgacgcagaatacagaggaacggactctcctcaattctatccgctttgccattgtggcggttccgtccctgattatatccctcgccacgccttacctgaaaagcggcacacaggaaagcaacagcacctatggcaatatcgcgctggtattcgcagtcattgcgaccgtctgcaccttaatctgcgttgccggtatcgtggagcgtgccaaggcccccactgccagacagcgcacctcgggcaaagagtattttaaggccatcctcaaaaaccgccagctcctggtggtcagcgcggccttcttctgcaggacacttggatattatatttactcctcgtccatggcttattatttcaattactacctgggatctgccaagctgatgggaattatcctgggcatatcggcccccatctccgcggtggcggctctctgcgtgactcctgtgtccaggtacatgggcaagaaaaaggccctgatgggctgcggcgttatctttgccctgtccagcgtcatccgttattttatgcctttaaacacagccgtggtggcagtcacctgctggattggcatgtttgtcatgagcgctaccctggccatcttctttaccatgatagcagacaccaccgattacggcatgtggctcacgggcaagaatgtaagagctgtaaactatggtttctacaccttctgccagaagattggaatggcattctccggcaccattgtaggaatcctgctggacatggccggctatgtccccaatcagcagcagacagacgccgcactgcggggcatcctcaatatatactgcctgataccggctgccatctatctcatcatgacggccttcatgctgctatggaaactggatgaaggcaggatgcatgaaattgtggccgagctggaggtaaggaggcgcctggaaaccaatgactaagcagatccgcaagggatatggaactgtcatcctggcatcgttggcatatggtgtaatgccggtggtatccaagctattgcttttgtcgggaatgaactcagagagtgtggtgttctaccgtttttttctcacatgtttgttctcggctctgattctggctgcttttaggagatttagggccgtgacccttccacaggcggttttgctggcgctcttcggcatactgggcttcggttttaccatgcagtttctgaccatctcctaccagtatattcctattggactggccaccgtgctgcatttcgcctaccccctgttcgtaacccttatcatgctggctgtttatggtgaaaagccagctccggccaggctgtggggatgcgctgccgccctggcaggcatatgcctgatggtggatctgaaaggcggtttctccccgggcggcgttatatatgccctgctgtccgccgtcacctactccgccttcgtggtctccaacaaaaaggcatgttatggcagtctgagtcctatgctctgtctcttcgcgttcagtctgtcagccagtctgttcttcggactgagctgtactcttacaggcacactgcaggctccctgctccctataccagtggggatgcctgatggctgtcagccttctgtgcacggtctttgcattctgtacccttatgaccggcgtacggattctgggagctgcgaaagcatccgtcatcaacatgctggagcctgcaaccggagtggtgtttggcgtcatactatttaaggaaaaactgtcgttaaaaataatgattggctgtgcctgcatactggtatccaccctgattacggtcctggccagggacagccgcaaagatggaggtaagaaaatatgaatgaattactgtcatgtgataccatggtcgcccttgggaacagtacaaagtccggcaatgtaatatttgccaaaaacagcgaccggcccctgggggaatcccagcccctctgcctgtttgaggctaaggactacccggaccaggagctgttatcatgcacctacatatccattccccaggtgagccgcacctataaagttctgggctcaaagccttactggatatggggatttgaacacggcatgaacgagtggggcgtagccattggaaatgaagccgtgtggtcacgtgaggaggaggaacgcgaaaacggccttctgggcatggacctggtacgcctgggactggaacggtccaaaaccgcatatgaggccctccacgtgatcacagaccttcttgaaaccttcggacagggcggcaacgcctctgtgaccatggatttccgctaccacaattcgttcctgattgccgatacctgtgaagcctggattctggacacggttaacaggcgctgggttgccagacgggttaaaaatgcggagggcatatccaactgctacagcacgggagaacactgggatgaggactccggagacatccaggaacatgcctatgagatgggctacgcggacagaggacagacctttgactttgccagggcttacggcgccgtaaacctcaaactgcgtgcagcctatccccgctataaaaggcttaaccagctcctggacaggaaaaaaggcatcctgacgccggactacatgggaagtatactgaaggaccattttgaaggcgaaatcattgagccccgctggagtcccgcagatggaatcctggcatctgtctgcatgcacaatatggatgaatcctccagcaaaaccgctgccggttccgtggtggaactgtcaaaggataaaacgcctgtctggtggagctgtatgtccaatccctgtatctcggttttcctgccttttaccatggaaaccgccattcctcagaaggtgtcccagggcagcgccaggtacagcgatgattccctttggtggaaattagaacggctctcctatgagctggaagaggactatccccgcaacaccgccctctggaatcctgtaaaggaaaggctgcaggagtacatctgctccctggcggaaaaagggccggacgacagccttctctgtgagatggcttccaggctggaagaagcagcggatgaaatgtatcttgtgctgcgtgacgccaatgcctccagcagccagccgcagagaagggcagtgctgagggcagcacgcaccatggccggcattatataaccgctgcctctgccgcataaccgcccatagggcgcatcttccgggaagtcagtttacaagagactatacgcataccgtgggctgctgacaaaagctgacaaaaaaataacaggccgggtccccgcaccaaagggtgcggtccccagcctgttttcttatcttatcattctgttgggtttttccgtttccggacgtcctcatcctgcctacttgtacagtgacagaccgtctatcaatataatgggatcatcccactcattatccgtaaccagagaaacctccacgcggatctcattctgtccggtcacatccacgccaaagtacatcagcttttcattgtaatggatatcctgtgatgtatagagtacagtatcattgtcaccgtatacagttatcttggccatgattccgctgctgaactgggatgatggagctatgacgccggataaaagcctgtactgaccgttggcagcatattttacatagcttccctttcctttcagacggatggcattattccagcgctcgccggtggatgtcttgcccgatgtaatgatattgtatcccttggtggaaaggccgtccaacaggttctgcaccagatacggcgtggacaggtctgtaatattggccggttccacctctccctctgctgcaatccatacgccgtccgcaccaatctggcgtccgtcaatcactgtgttcgtggccatggctccgtttggaagcaggaagtaccatttgtcgttatccttaaaccagcccttctgcatgactcctgcctggtccatgtaataccactggccgtcaatctgctgccagcctgtggtcatgacaccgttgttatccatataataccagttgccgttatcctcaatccattccttgtaggcaaacttattggcgcctctctgatacttccactgatcatttacgtatttccatgtacctgcataggccggaaccgacataaccacactcagagccactgctgccaatgtaaccgccaaacgtttcttcattctgaatctcctttcattctcccctgactgccctgtcacagacagatattattcatcctgcacttgttacattataattcattctttatttttatgcaactgtgtgttcaaactgtaattaaactgtaaagattaaatacttccaggaaataccttgacaaatcaatctgtaagtattatagttacagtacgaaatgtatttttaagagttacagttattacctgtctgttaacagtatcgagaaaggagcttccctatgaacacccgcgaacacacagccatgaagatgagaggaaacccggatatctcctatctgggacataccgttgatcagatgatttggagctttatggaacaggaaaaaattgacggacttaccttagccattgtacaagccccctacataccaagggtagccggatacggctattcggacagccggcggcggcgcctggcttcccccaacaccatgtggcccgccggccctatctcccaggcctttgcagcagtggccgttatgcagcttcatgaggacggcggactggatgtaaaccgccgggcttgcgtatatataccggagcttcctgatgcatggaaggatatcacggttcttcagcttctgcgccatgcatcgggactgccggattaccgccgggcgcctgaattccggccggacacaccgtggacatttgatgccctgctccggctggctgccggaaaatccctgcactttgtccccggtacggatgtggagcagtgcgctaccaatttcctgctgctgaccgagatcgtcgaacgggccagcggcctaagctaccacgattttgtaaccaaaaggcagattgagttcctgggccttgggcacacgggcttcaaggaggatttaggccagttccatcacgaagacatatcccggaccgctgatatccaccagttgttcaaaaaggacagactctatatcaatcccacggagccagccgtatcctatgacagcagcggtactcccatcacggcggcagaaactacggcgcttcggggcttttccgacatttgggcctccgcccaggatatttccttctgggacatcggcctggccggttctgtcctgattcatcagccggaaaaccgcgcccttatatatgctccctggaaccttcccgacgggaggacagtacctgccgcagccggctggcagttctaccatcaccggggacttatggatataaagggatccgtccatggctattcttctttcctgagccgcttcacagacgcctccgagctggtctgcgtcaccctcatgtgcaacagggagggggtggacttcaccaatctggggcgcaggatagccggcgcatacggcgaccttctgtccaccgggtacgatgacaaccgtctctatcttctggaaggccagttccctgcggcagaaacagtgtcacgcctggaatcagccttaaaagaccgcggtatccctgtatttgccaaattcgaccatggacagaacgctgccggtgcagggcttttcctccgccccaccacagtactggtattcggctctccccaggtaggcaccggactcatggaagaagatcagagcgtatccttggaactgcccctgcgcatcagtgtatgggaggatgaagccggaagcacatggctggccttcccccgcctggacaaggtattcggtgaatacgggctggaaaaccatcccgctgtccccaagatgcagaaccttcttgaacagctggtgcatataggaggcagcatctattaaccggaaaaccacaccgcaaaaaacaacccataaaaaggcaccgctccccacaatccgggaacggtgccttctcacattctgcctttattcttctatatatactccggggctgttcagacagcaccggacatcaggtattcttcatgataacgctttccaccacatctgccacatgctcacaggcatcgcagcatttctctaagtatacgtaaatctccctccaggcaatgatttcaatgggatcggtcacctcggcgtgaagcctgcgcatggactcaatgaacagccggtcgccttcctcctccagagcgttaatctcgatgatcaggccgtgaagtgtcttggatttcctgaagtccgcaaactcctccataacctccttaagggcctcgcagcagcggatgatgacctttatgaaggcaagggcctcgggacggatttgctgaacattgtttatgtaaatacgaatcagtacatcctcaatcttgtccgtcacctcgtcgatactctggctcaaaagaataatatcctcccgctcaatgggggtaataaacgccttgaccagcacagccatcatctcatgctttttcttgtccgcgtcatgttcaatccggtgcagttcgtccagcttgtcctgtaaaagccctgtatcaaaatggtttaaattgtcctccagcattttggctgcctggcatccgcactcaacgcactctatgaaattctgaaaatagtaactatcacttttcttagacatcttatcttctcctttacttatccgtggaacaacatcataaacagcttcgctatcaggaatccgatgatgccgcagccggggaatgtcatgacccaggtcatcaccatgtccttaaccacgctgaagttaatggccgacagacgtttcaccgctcccacacccatgatggctgtggtttttgtatgtgtggtactgacgggaataccaaaaatggaaaatccgagaagacaggcagctcccgccatatccgcggaaaagccctggtatttctccagacgtaccatatccatgcccacggatttgatgattttctttcctccgatggacgttcccagtgccatggctgccgatcccaacaaaagcatccacagagggaactgtactccctgggtattgctggacccgttgaccatacagatacctaacagcatgactcccataaatttctgtccgtcctgtgcaccgtgcataaatgccatggcggcggctccgccaatctgggcataccggaaaaatccggtggttttccggcggtccatatcccggcaggtccaggccaccagcttgcatgaaagataaccgcttaaaaatcccaatacaacggaaaaaatcagaccatagaccaccttcatccactctgccgagttaatggctgaaaatcctccgcggatagccacggcagcgccggtaaggccagctatgagcgcatggctctcactggtgggacatccaatggaaacagcaaaggacgaccagaccacaatggaaaaaagcgcggcacatagggcaaccagagcaattgaagtatcttccccgaaattgaccatattggtaatggtcatggcaaccgtggaattcaccatggtcatcacaaccactcctgcgcagttgcatactgccgccataacaatggccagattcacatccagcgatctggttgacacgcaggtggcaatggcatttggcgcatccgtgataccattgacacagatgaccccaagagtcagaaggactgtaatcaacaatgccggatttgtcaccagctgccgcaggaaaaaggaaaacgacatgtccataattcttttttacctactctcttaattatttactttatctttacgtaaaatttacaaactcacgattttaattctaacacggttttttatggtagtaaagttcaatttcgttaagaaacaaaggaaaatattcgtttttggataatagaaatggtatgggataaaatggaaaacgcctgtattatctatatatagataatacaggcgaagcagacaggacaaatatggtttcatactctttgtacgctctcagggcaaacatactccaattattgataatgttttgtcctccatttgtatattcggtttttattggagctctggttttttattggacttccggtccgttcagccctgtatccatgctcccggagcggaacccttctgcatccagggttatatacacaaaccccatttccttcaaacggctgacgatttctttccggcctttcataaatacctcaaaggcttccggatccagttccaggcgcacgatatctccgtgaagcctgagacgtacattgccgggaaccatagtcctgacataggcttctccctccccaattcttctcagcacctcatagtccagagcagcgccgtagggcaggcgggtagccatgcagggagtggacggacgggatgccaccgatattccgtactctgacgccagggcctttacctgagccttggttatgtgcagctctgccaggggactaatgattcccagctccttaagtgctcggattccggggcggtatacatgcatatcgtcctcatttgtaccgtccaggatatacctgattcccctggcctctgccagctctgccagtctggagaacagatggcgcttgcacagataacagcggtttaccgggttgttttttattgattcctgctccagctcatccacggtaataacctcatggattcctcccagctcccctgccacgcgcctggcaatctccaggtcgcaggaaggatgcaggcggctgtcaaacgtaacggcgtacacctttcttcccgtatgggcagctgcgtctgctgctgtctttaaaagcaggcttgaatcaactccgccggaaaatgcaaggcatatatcctctttggccagctgctccatcctggcctccagacactttttcatctggtccggagatgacatttcatcactgaaactgttatttactgtattcatacgaatctcctaatctgacattatccatacatttaatcctgccggctttcctctgcctttatacgtgcctgatgatatgcggtctgaaaatccacaccctgttccctgcaaatccgccggatgctttcatattccggataaaaaaacgttctgcccttgtaagcacacaccttcacatccgccggcccgtaactggtttccacctggattttactccgctcaagaatggtcctctccgtgggataacggcggattccaatggtagtggtctgggtaagaatgatttcctccatggcctctatggatgattcacggcaaagcacagacagcatgtaggcgggacggtttttcttcatgtgaataggggtataccacacatccgcggccccggcatcaaggagcatctccatagcaaggcccagcatttccccggtacagtcatccaggttcgtctccaatacccacatggtacggtcctcttcctgtgaagtctccagaagcatggcccgaagcacattcgcctgtttaaacaccttgttccccgcacccattccgaccttaagcagacggcaggaaaaaggcagccggtcctttgtccgcagagcggcggcaattgccgccccggtaggtgtaaccatttccccgtcattgtctgtaaaatgcagcttaagtccataggaggaagcaatattagcagtcgccggaacaggaaccggcagtacgccgtgctggcagtggacatggccgtgaccttcagacaatgcagaaaccaccacatcctccacacccagattgtcgatgcagactgccgcactgataatgtccactatagaatcaatggctcccacttcgtggaaatgaacctgttcaacaggaagcccatgggccttggattccgcctctgccacaatgcggaacatggtccgggccatttccttcaccctctcattggaatccagacggtctatgatatgataaatgtcgtggaggttcctgtgaacgtggggatgcggatgactgtgctcatcctcatgaccgtgctcatgctcatggccgtgaccatcctcatggccgtggccatcctcatggccgtggccatcctcatgacagtgaccatcctcatggccatggccaccctcatgacagtgaccatcctcatgacagtgaccatcctcatgccggtggccttcctcatgaccgtgctcatgctcatggccgtgaccttcctcatgccggtggccttcctcatggccgtgaccatcttcatggccgtgaccatcctcatgacagtggccttcctcatgccggtggccttcctcatgaccatgctcatgctcctccaaatgcacatcaaaatcaaatgcatccagaccgctcacaaccttccgtccaaaatgcagatggtatccatccactcccaggctctccagcgcattctccagcacctgcctgtccgctcccagatcaagcagggctcctaccgtcatatccccgctgatgcccgaattacattccagatataatatcttccccattttatctcaccgccattctgtttatttgggtcgccaggtaaccggcgccgtatccattgtcaatattaaccaccgatatcccgttggcacaggaattaagcattgtaagaagggccgacagcccgtggaagctggctccgtatcccacggaggtggggactgccactacagggcattccaccaggcctgctatcaccgtgcccagcgctccttccattccggccactgccacaatgcagctggccttgtccagacgctccctctgggccaggagcctgtggattccggcaactcccacatcaaatatacggtctaccctgcatccgaaatattcagctgtctgggctgcttcctctgccaccggtatatccgccgtgcctcctgtgcacactgccacataccccttgcgctcctttcccggcttctccaccttaagtatgcgggatatgggatcatacaccacctctggcaccgctgttctcaccagctcagcctgcttctcagaagccctggttcccagaacctccccgtccctctcataaaatttcttatatatttccagcaaatacgcatccggctttccctggcagaatacagtttccccaaaaccggatcgcagcttcctgtgatggtccagcttggcatatcccaaatcctcataaggcaggttcttaagctgcttctctgcttcttctatgttaacactgccggactttacctgctccagtaattccctgacatccatctttcgttctcctctctcaaatccatacggcttggccgtcccgtttccaatccttccacatacaaatcatccggccgccccgtccctaatccgtcctcaaatcaaccaccctgccgcaaacacactccagcagctcctctgaatggctgaccaccagcaggcccaggtcccgcgtcttcacttcctccaaaaggaatccccagatctggctctgggtgataaggtccagcatggtgcttatctcatccgccagaatgaaccgggtgcgcttccccaatgccctggctatacagaaccgctgcagctctcctccggacagctcacccggataccggttcagccagtccggttcaattcccagaccgcggaccacccgttcctccacaaaatccccttccctcagaacttcccgcatcttaaggcggggatttactgacagttccggatgctgccatatcatctgcaccggattgtaaccggcacaggaagaaatatttttcccgtctaacaccacagtcccatggtccggtttctcataaccagccagtatcttgcaaaaggtcgtctttccaaaaccgctgggagctgtcagccccacacgttccccgctctccaggcttatgctgacattgttcagtattttcctgttcccattgtcgtattggaaagaaatattcatagcttccagcttcatattcccgccttcctgcattttaccatgccgccgcgaaaactgcgataagaaatttcctggagacagccttcatccatgtccgggcagcggggcccatagggacatcccgcgggcatattcgccgcatagggctgggtcccggatgctgccttaaatccgtgacggggcatggcctggaatagagctttggtataggggtggcgaagcctttgctcatcctcaaaatcctctgccagggcctcctccacattggtacctgcgtaaaataccacgattctgtcagccacctccaaagccagctccaaatcatgggtgataagaaggacccctgccccctggtccgctatctcccggaagtgggacagcacacgcctggccgcgctgatatgaaggcccggcgtgggttcatctgcaataaccagtctgggatgctccatcacggctgtggaaataagtacccttctggtcattcccccggacagttcaaaaggatacagctcttccgtatcctctcccagcccgtagcgccccatggattggcggcagcgcttcacgctctccctgtctttttgtccccttcgtacctgttctcccaccttcataagcggatccagatacgacacgctctgggggaccaataccatccggctcccccgaagctgttcctttttcttctgggtcaggatttctccctcaaaggaaaccgtcccctgacaggcggcattctgcggcagaagtcccatgaccgcatgggccagcaggctctttcccgaaccgctggatccggctacggccaccacctcatgttcccgtacctttatgttcagatcccgaatcacgggaagctccctctggcgccatccccccacatactgggaaaatgagatcatcagatgctccaccgacaatatgacttgtttttcctccaaaacaacctcctacacaacaaacctctgccacggcacaggcgattttacagatgggcctgggccgggtccagcagacggctcagcgtatccccgataaaatggaacaggaccaccacaaataccagcaaaagaccgggaaacagggccagccaccacttccccatgaccaggtatttcatgctctcagacaggataacacccacggcaggctgctccggcggcagcccgaagcccagaaaggttatgctggcctcatgaagaattgcatggggaaacagcagaaccatgcccacaaaaagctggggcagcagatggggcgtcatatgtttgaaggcaatataaaaccttccctttcccagcttctttgcaatctgtatgtactggctctcacgaagctgtatgacctccccgcggagaagcctggccagggaagtccagtgagtcagtgaaatcccaatcagtacaccccagaatccctttcccactgcaaaggaaatgagaatcagtagcagaatatggggtattcccatgaccagatcaatgattcctcctatgacagcatccgcggccctgcccagacaggctgccatggttcccagaatgaaagccaccaccgcgctgatgcatgccgtcaaaagcccgatgcgtatgctgatggataaccctgtaagactgcggacaaacatgtcccgccccatccagtctgtcccaaagggataggccaggctgggcggcagattttttctggtgaaatccgtggccagggcctgctcccttaatacctggccggcaatggcaatggctgccagcaggaggaccgataccgccagcagcgcagccatggccttgcggcggttccatctgtgtctttgtgcgctcatgccctgctcctcctgattctgggatccaccgttccgtacaggaggttggcggtgaaattccctaaaaatacaatggctgcgctgataattgtaattcccataagcagcggcacatccccgcctaatccggctgtcacagccgcctgtcccaggcccggataggaaaatacctgctccaccagcacggatcctccgaatatctcgctgactgaggcaaactggagcgtcatggcaggaagaaggatgttgcggattccatgcctgcggataatggaccattctgactctcccctggccctggcaaacaacacataatcgctttccatgacctccgccatcttctcccttgtatgaagggcaatgttggagatgcctgtaacggacaatgccgccgcaggcagtatgccatgaatcaggcggtccttcatggtcacagccgaggcctccactccgattggaacagaaagtcctatggggagcagcttaagccagaccgcgaacacgacaagcagtaccagagccacccagaaggccggcgtactggcagttaccagggcataggaagagataattcggtccgcagtctttcccttctttgccccggcaatgattcccatgagaaatccaatcaatcccgacaaaatccatgccgccgccataatccaaagggaattggccagcttctccccgattacctgggcaacaggcctgcggtacaaaagggagatacccatatctcccttaagaaaatcaccggcccaggccagataacgggttacaggcggcgtgttgacgccccagtattcctggagtctggcaatctgctcgctgctcatgcttccaagggccgcctgccccacattggtggtaagcggatccaggggagaaaccgacaccaggaaaaacgccgccatactcaccagcaccagcagaaccgccatccgtatgaaattaacacccgcctgtttccaactcataattttatccttcctgcccacatacaattctgtctgattttattcccagctccactggtccacattatttacaatggaccatccgtgtccatggggatggattttctgttccgccacctttagtccgttcctggaccagtacaaatggtctatattaaccagccaaatccagggaatatccccatcctgggtcactcccgcggtcccgtcccactgggccttcttccacagctcgtaggaatcctccagattcccgctggccagggcttcgtccatgtaccggtccacactgtcattggcatagggtgaatactccgccaggccggtatccttcatggtatggtaaatattgtaaagctccataggcgtatgggcaccccagccccacataagcggctctgtctgggcgcggtcataggcgtcatcccagccaacaccctctatcttcacttcaattcccacttccttaagctggttggccgtgtccgctgccagagcctggcgtacggaatcgctggccgggtacatcagtgtaaatccggccctgacgccatccttttccctgattccatccgttccagccttccatccggcttcctccaaaagctctgctgccttttccgggtcatactctgttttcgcagactcattgtaccagggcatcttgtcacacacgctgtatgccgggcttccgtagccgttcagcacatggtcaatcatttcatccctgtcaatcccaatgttcacagcccttctcacctgtatatccgatgtaaaatcatttcccacaacggttttgccgtcagttacagtgcctgactttacagccggaaggttaaagccccggttatccactgtctcgaaggaaagcagctcatatcctgggagagtctggtctgaataggacgcagccgtataggccaggtccgcctgcccggacatgacagctgcataagccgcgtcctcctccatgaaaagtatggtcactttcttcattttcggctctgtcccgtaataatccgggttcgcctcaaatatgacctgctgtcccttatcccactgtttcatgatatatctgccggatccaatgggatgtgaaccgtaatccgccccataggcatgttccggtacgataccgacaattgccatggtgtagggccagatggagtagggccgtttcatatgaaataccaccgtggtatcatccagcgcctcagcactctctaacatggtaaagtcgttgacagagctggtatcccgcagggtattgtatgtaaatgccacatcccgggcagtcagcttctctccgtctgtaaaattaacgtcatcccgtatattcacggtccaggtaagcccgtcctggctcacctccatactggttgccaggtcatatcctattttcaggtcagcagtcgtcacggtcagcgtactctgaatcagcggctcatggacatgttcgcccgccccccatccgtaggcaggatcaaatccggcctccggctctgaggttggccccatgacaaccaccacgtcgtcccttgttccattattccccgtctcccgggcgccatttcccgcactgttttccgcgctgtttcccgctatatctcctgcacgttttcccgcactgctccctgcactgtctgcagccgcagatatcccgctgtccttagcgctgtttcctgttccgctgcctgcgcagcccgtcacagccatggacacggccgccatggctgccacggcatatttcaatcccgttctcattcctcttctcatttccctctccatttctttttttcatgccctgtccgtatgcctggattccataaacttacattccataaacttacattccatacgctcacatcctattcctgtaagcgcagatgccataaacgcaatccgcaccccggcgcaaaagcacaaaaaaataccagaataagtgtatcccttgagaatacatcctaccttcctggtatcccttacttcttaaaaacttattcaatctcactaaaatgcgcttgtctggttcattctggatgttgacttctgtcaaccgttaggaaaattatacgcaaaagtccgcaaaaaatcaacgcttttcttgccaaacgtttgcccatatattaaacagtcagcccaaacatccccataaggaggaaaaattcccggggagccaacacctccccgggaacttttaagcgtatctatgcgcctttcttaccagtctcttaatttattccctcttctgctgaacctctacggtacgtccctccacgtctttcgggtctcccacggtcagtccccggactgcctcatccgggcacgcgtttgtccatgcaagcttcatgacatcgtctgctgtcagctccttcttctggatcactcccaggcggatgtagtcggctgcaatattgccaagggcctcctctgtgattgcgtcagaaaggccgaaatccagggaatcccagaactccagctgattttcaaactcacctgtcatcttattggtgtcaaacattaactgcacggcatcctcagagtggagacgggcatactgacctgcacgtttaatcgccataacaatgtattttgcgtgaaccgggttcttcgcaagaaaatcattgttcatggcggttgcgcagcacacctctccctcgaacccatcgccgggggtaatggagcataccttgcgcatcttatccctgtaattggcgattacaaaataatccgagaaaatggaagcgtctatctcgccgctctccatggccgcaacgctggccgcgctgtctgcgatatcaagatattccacctcagaggtagggtctatcccctccccgtccagcattcggtagataatattctggtcggagtttccgatgccgtcatggatggcaatggtctttccctttaaatcctcagccgtcttaatctcgctgtcattgaatacgtagatggatttgcagcccatgtgggctcctgctacgaatgtcatatccacaccgtttgtcaccggcacaagcatggttgcgatatggtctgttccccacaggcacttccctgtgccaaccgtgatcacaacagactcgccttcaatgtattccgcgttaataccgtaatcctcataatagcccagtgcctcggcaaggtataccgcagacacgcaggcccctccgttaaacagataatttaatgttgttccgaaggcaggctctttctgcatggcctcccaatcctcctgggacacagcctccggacggcctgggcctccggttgcctcctcaccggttttcccggaatcctgtggctctgccgctgcccctgcttccgcttttgtctccgctgccacagctgctgtggatgcgctttctgtggttgcgccttctgcgggagagcctcccccctgttccccgcaggcgctcagggataaggccatcattcccgcaagcgctgccgccagaatgcgtttcgcatttgtctttttcatcatactgttctcctttttgcttttaatagttatttatgtacacaaaccatggggtctgcgtttttttctttacagggtcctgtccgctttactgctgacctctgttttttccgccgaagtgcaggcggttgaggatttcattccggcaggccacaaaggtctgcgatgagcgctccctggggtaggcctggtctattttaatatcagaaaccacccgccccggatgcgcgtccatgacaatgacccgtgttcccatataaatagcttcatccacatcatgggtaaccataatcgcaagctgctttttctcctgccacacctttaagatttcatcctgcatattcatgcgtgtaaatgcatccagcgctcccaggggctcgtctaacagcagtatatccggctcgttaatcagagaccgcaccagtgaaacccgctgtgccataccgccggaaagctgtcccggatagtcgtttctgaaggattcaagaccgataattttaagcatcctctctaccttctcctcattccccttcagctttccctgcagctttaagctgaaggaaatatttttttccactgtcagccatggaaaaagggtgggtttctgaaacatcattccccgctccggcgacggccctgtaatctgcgccccattaacggtcagatggccggtggtaggcggaatcagcccggctacaaggcggagtatggtggattttccgcatcccgacggccccacaagactgataaattcaccgctcttcatggaaagattcacctcgtttaacgcgtgggtaacctcgtcgtgctccacctttgcaaaactttttgatacattgtccaaccgaaggataaccgtattttctgccattatttcactactccgttctgccacctgagaacccggcgtttaatcaaatccagcacctttgtcacaatagtaaaaataaaacagatgacaaacagcgctgcaaacattttgtcgtaggccgcccaggatttagcccagttcatataccatccaagccctgcctttacccccatcatctccgcaatcatgattgcaacacaggaggagctcatggcctgggtgcagccctgtaaaatagagggcattgcatgaggaatcgccacccggaagacaagctgcccctcacttgcccccagggtccttgcggcctcgaagaaatccttgtccacattctggatgccggacatggatgccacggtaactgcaaaccaggagccaagggcaatgataaacacggctcccctgaacagggaggctgccacaaccatgataatgggaatccaggttgcggtgggaatgggtcccagaaatttgattatcggattaatccagtaccgcgctttcccggaataaccacaggtaattcccgtaaccagtcccagggcaattccgataaaatatcccaaaaacagcaggcgcagcgtgtgaagcgtacattcaagcagataagcccggtcctcccatgcaatgttcaatatgctgttcatacacggaacaaagggctgggacaggatgcctgttttcagagtcagataatcataaaaggtaagcaggagaaaaaaagcagaaaacaaaggcgctcggtagcgcaggtcctccgcagtccgcttatcccccttcctgtatttcatcccggctgcaagggcatagagcgcgtatgcagtcataaaggctgccactgcccacacataggtgtagggatggctgttgggacttccgtttgggacctcccagtactcgataacagcgatgaaaccgcagataaccggaagcagcataataacgaggtccaggattttctgaccgcgtgttttttccctctgctccagttcctttaactgctgtctcgttagatgtcccagcggatttatctggctgctgccagagacaggcttttcctccatagtagttgacatagtccttctcctctgcatgtgatggatattaaagcattaaaatatcgcgtttctattttaatccaaattcaactgactgtacaatttaaaataactaagatggaagccgggtttatagcttaattctataccagtttttatgagtcatcagaaaccggcaaaaaaacctcccgttttatggatgtttgcgcaaaataaacgcaataccataaaagggagggtattgatacggcagtgtacaatgcctctttattccgttttcctaaggtttacatcagcttaccatgcatatggcacgcgcacccgcagtcctcctgtcccttaccttcatacgcctcatccttcatcatcagatggacggcgcccagcttaaaggtctggggaagagccaggatattgggattttgtcccacgaactttttcctggcatcagccagcgcttcctcgatggtggccctggtcttaaggcccatccccctggcatagcccggttcctgggcgccgcacagatagatggcggaggtattcatttccgctatatggccgcagctaatcatggaaaagccgtggaatgggtggaacgcattgcagtaacggtattttctgatgtattcctcattggtggcgaagtattcgccgtaccggttcatgtccggcagggtgttcataaaatcgtgctggaacatctcatacatttccctggtgtagggccacagctcatcgtggaaatagccgttgcacagggaagaacagataatcacgcagttatcgctcatgatacgcttatgccggatgacctgggccgagatggcctgcatcagcataatgggattggtacccatgccctcgccgtaatggaaaaactggggcatgccgaatatcattacatcatacttcttttcagcccacggcacataggtcctcttatccgccgtaatccaggagtggggctgcatgacttttgcatatccgctgttaatctctatctgacgggacctggtgtccagcactgcgtcacagcagaaaaacttctttcccatgcatttttccatgtactggccaatctcatcaaattttgtcctcataagcgacgttccgctgaccggagtaaaatccttccggtgcatgacctcaggtacatggtgggaggctatggatcgccaatgggtgatgcccgtggcgcagtgcttataccctccggagtagccgccgtaggggttgccctgggtgtgtccgatcaggattgccacatcgctgtcatacacatatttattcatgagcaccggatcgccgcggtccgtggtgcccaggtccaccagatgctcgtaatcctcgctgtcatggttgataatctgatgcgtgtgccagaactcatgaaacagctcatccccaaggatgttgtggatttccgtctccgtgttcttcctgtgaagtccgttggagcagattaaaaggatgtccttcttctccactcccgcgccgtacagctccttaagtatcaatttaatggatatttttctgtgggaagtgggctgttcccctccctttaccctgtccgggaaaataatggtcactttggaccccttatgggctagtttggacagaggctccattcccatggggtttcgtatggattccagggttttttccaccagctggtcctccgggatacagggcgggtctgccacagtctcgccgggtatgaacacatcggtgttgtcaggaagctctgccgccataagccccgcaccatattcaaatgataacttcatatgataatcctcctgtgattttcaattgggttccgtaatattcagtctcgctccagataggtgcgcacgatctccagatactcctcaggatagaatccaatctgtccctggaacctggtgagggcaatcaggccgccgtccatgacaggaaccgaagccagcatcctggcattgtccgtcttaaggccgcctccatagaccacatccatccctccggtcatctccttaatataggtaccaatcttcgtgatatatgcttcatccggcggcgtcttgcctggtccgatggcccatatgggttcataagcaatgaccaccttctccttgtccacatccttaagccctgtttccagctgcgatttcagtacttcctgccagtgttcctgttcaccggctgtttctccgacacagtaaagaacggtaagaccggcctggatggctgccttgatttcctgattcagcagccttcctattgcgtcttcatccgtgaccccggcttcttccaggattccggccttatccctgcgttcctcgcagtgtccgataatgacagaactgcatcccattgccttagctgcattggccgtgcggttggtggtaaatgcgccgaaattgccgttctcagccgtatcatccctgtacactccctgacagccaatcttaaccggactgtgctcacacagggcttttactgccggaataagatgggcttccgggaaatacatgacgaactccacatcctctgcgctgtacgccttcagcttttcctgggtgttctgaacaatatagctcccccattcctccatgggcgccacaccgttgacccctccgtactccctgggtatatcgaaccgtttcaggttcagaaatatgtgtttcattttcccactcccatcttttcatactcttctttaaaatccacaaaatccctcagttctggtccgataaggggcctgcaccatttcagaaacgcgtccgtcacatcattgcccctgtcatttatatactcatccggcagaacccgctcatgaagcatcacctctttgatgggtatggccgaggtatggacatgatacccgccgtcctctctctcatcccgtataaggccgatcatgacgccgctgcggcctgccatggctgtgcgcagcgcctgacggccggccaaaactgcctcgtcccggtccacaggagactgccaggcaatggacgcccttccgcaaagaccgggcttctcgcttctggccttgattcccagcttctgaatgaccagattcgccaggtaagcgctgacatccccatagtaagtggctctcccaaccttaaaaataggaggcacaatgggctctcctttttcatttttaagcccctcgctggcaaccaccaccacgcctcccttttcatcgtaaaggcgttttacatcctccaggaattcctcctcatgaaaggggcgctccggcagataaatcagatggggcgcatcccccggtttcttcctggccagggcagacgcggctgtaatccatcctgcgttgcgtcccatggcctccatgacgcacacatggatgggcagggctttgacatccgctcccacctctgcggcggatgcggcaatgaacctggccgcgcttccatatcccggagtatggtctgttatggcaatgtcattgtcaatggtcttgggaattcccaccacatagatgtcctctcccctgcacgcctcaaagatgcggccgcaggtatccatggttccgtttcccccgttgaggagtacataccgtattccatacttccggaagattcccgccatggcattgtagtcctcctgtttaagggcataccgtgaggagccgattgcagtggccggcgtctgaagcagaagactcagcttttcctccggatactgcatcaaatccagaaaattctccttcaggattccttcacttccgccaattgccccgtacaccctgcctatgctgccggagcttttggcttcctccactacgccatacagggaagcattgataacagctgtggggccgccgccatggaccaccagaacatttgccgacattgcctctaccacctttctcattgattcaatctgcattttcttaaatctgcattttcttatagcgctcagccatctcctccagggaaacccgttccaccaggggagctttcccgtaagagccaaactgtacgatgagggttcccaccacttccttcacgccccgttcaatacagtccgttatggctgccgtgtcctcatccggtatgacgccggtcatcaccgtatccatgattggagtcaggaatactcttgggtcaaactgctctcttttagactctaaaagctcatagatggccccgatggagctgctgtttctcttctccgggttcccggcgaaaaactccttcatattgcgggtaacagccagcctgatgtccgtatccacattaatcttgttgataccgcatctggccgcttcctgcagttcactgacggcaattccataggtgccggtcagcgtgcctcccagcccgttgatttcatccacaatataggccggaaccgtggacgagccatgggataccagtgctccgaaaataccctcatgattcaggcactcccggatggccaccgcaatctccttgcgcagctttacattctttcccttggaagccccgtgcatggttccgtaggatatggccagggcatccacgccggttttcctgaaaaattcaactgcctttaagggattggtataagtggatccctctgaaaatacatggtcctccaccccggccagcactcccagctccccttccacgctgacgcctcttgcatgcgcgtatttcaccacctcccgggtcagctccacattttcatcaaaggcaagggaggacccgtctatcatcacagaggtatatccccctgctatggcggccgcacaggagtcaaaatcccgtccatggtccagatgaaggacaatgggtatggggctgtccttcccatattttttcacggccccggcaatattttcagcgccctttttcttatcctccagggtcgcgttcataaagtcgcatcttccccccataaaaccatttgccaggtcggccccctgcagtatggcagcggagcggaacatctcatggacctggatggcagcctttgcctgggccaccgcgttgacgttgaaagcgccctgggcaaatccatgtttaacagaagcctccatgagaggcctcaatggaatcaatgtcatattattccttccttttccgacgtttcatccccggcagcgtcacgccttttccttagaacctgccagccggataatgtcttttatatcttcgcgcagccgcagttccgcgtactgtgataatttccaggcatggccctggtccttcccctcagccagcccctctttcagatagttcacatactggcagcgcacctgggtgccgaaattgattttggccactccgctgtcaatggagcgcttcaccagctcctcatccatacccgtacagccgtgaagaacaaagggtatatctgtaaactttctgcactcctccagcacctccacccggatatccacaggcccgttgtaaaatccgtgggcattgccgatgccgatggccagtgaatcgggatggcatagcttaagatactgcctcaccacatccggatccgcgatgttggatgcgcctatcttgtttcccctgtcatccagtcggcacaattcgccgatttccgcttccagcggcacgccaaaggacctgcacaccctggccactgcctctgtggcagccgcattttcctccacaggcagggcggaaccgtcaaacataatagaggtgaatcccagcttcagcatctccatacagcgctcaaagctgtccccgtggtccagatggattgcaaccggcacagataccttgccggccatccattttgccgtctcataaaaccagtcatggcctgaataggccccggtattcacatagtgggccaatataacaggggaacgaagctcctccgcagccatacatacggcccgtatgatgtcataggtcccaccctgggtattgatggcgggaaccgcataatgtccttcataagccttctgaagcatttcataagtggttgtcagcatgcttttctccttctcagatgttcacgatgactttcagataatcggacggggactgaatcatatcctttatggtatcctccacctggtccagttcaatcatttttgttatgatggcatctgtgggtaccttgccctcgtttaccagaccgatggcctccgggaatttcccgttggagtttctggacgggcacacgtcgatttccttctgcatcaggcgcaccgtgttaatcaataccgggtcatggggccatcccaccagggcaatccgtcctccatggcacacataattgtgcatgttctccaggatgaccggcgctcccgtacaatcaatcatggcctcaggcagcttaccgcctgtcacctcccgcagatattcctccacatttccgtctttggagttaaaggtgcatggtactcccagctcctttgcgtaatccaggcgcttttgcagcacatccaccagtatgggggttgcgccgtaattaatacaggcaaatgcagccataaggccgataataccggcgccgaacacaacacaatgttctccccttgataccctggccctggtcgccccgtgaaggccgatggttaagggttccaccagggctgcatgggtaaaggtcagttcatcgggaagcttatataaaagctgcaccggatgaaggaaatattcggacatcatgccgtccttatgtacgccgcacacatggagatccgcgcagttattgaaacgccctgccgcgcacatatggcacttgttgcagggtacatagggttccagggccacacggtctcccggctttaaccccttgtcattctccccgatttcccggatgatgcccacgccctcatggcccagcccgttaatgggatagcgcatggtggggttcactcccctgtaagcagtcacatccgaaccgcagataccgcacatttccatctttacgattgcctgtccttctttcagctccggcataggcaaatcttttatcaccaggtttcctggctccggcagacataataccttcatgttttcaatcctcctgattctttatttctaccaccatttaatcttgtcagttatatagttgcggtattcaataaattgggaggatgtgatatccctgggtcttggcaggtcaatccgtacctcctcctttatcttcgccggtttgttgctgagaatcagcacgcgctccgccagatatacggcttcctctatgttgtgggtgatgaataccactgtgctccccagttccttccacagacgtataacctcatcctccagataaaagcgcatcttcacatccatctgtccatatggctcatccatcagcagcaggtcgggctgcatggcaaaggaacgtccgatgatgattctctgctccgccgatacggacagctctcccggataagccttcctgaactcctgaagtcccatcagatccagtatctggttcaccctgcggtcgatttcagccttgggaattctcttaatcttaagtccataggccaggttatcctccacggtcagccacggaagggcgcttggctcctggaatacaaaagaaatgttatgtttgcgcgggtccgcagggactccgtctatatacagatcgccctggctgggcatatgaatcctggtaaggcagtttaaaaatgtggtctttccgcagcctgtaggccctactacacacacgaactcgcctttacggatattaaatgacatatcgtccagcaccagcaggtcgccgaatcgctttgtaagattcctgacctcgacttttatgggccgggtatcctctctttcaggcatttttgtcctcctattaaattgctaaatcagtgttgtcggaaataaccgtacgcagcttcaggaattccccgctcaccatatcccttggtctgggtatgctgatgggatatacttcctttaccgtggccggacagtcgctgagcaggatgattctgtctcccagatagcaggcttcctctatgttgttggtgacaaatatgacggtacgcttttccttttcccagattcttaagatttcctcctgcatctgatagcgggtctgggcgtccagctgtccaaagggctcgtccatgattaacagcttgggatccgccgcatacgccctggcgattcccaccctctgcttcataccgcccgacagctgggtgggataggatttctcaaatcccttaaggcccaccagctctatgtaatgctgtgcaatctccctgcgctgtaccttggacatgccgcggaatttaaggcccagctccacattttccataaccgtcttaaagggcatcagggccagcttctggaataccatgctgatttccgggtttacgcccttccactccctgccgttgtacacaacctttccttcggtctgctgctccagtcctgcaatgatgttgagcagcactgttttgccgcagcgccccggtcccaggattaccaggaattcgccgtcgtttacatcaaagctcacatcctttatggctgtaaaatatcccttatcgctgaaaaacgtcttggatatcccatttatttccattcgtttatttagttgttccacgggcacaccaccttctcaagtttttgaagtcccaatgacaaaagggcgccaataattgcaatggttatgacagagacaagtaccagggccatatcgcttccctgccagcctctggtcaccagtgctcccagtcctttctgggcgcctaacatctcagccgccagcaccgttgtccagcctgagctgaccgaggtccgtattccggcaaagatggagggcagggccgtggggataacgatatccgtcagtatctgcctgttatttccgccaaatacatggcctacatccagattgattttatccaccatctcaattcccgtggaggtgttgatgactaacggcacaaaggttccgatgaacaccagcagcacctttggaaattctccgatgccgaaccacatgattacaatgggaatccaggcaatgggcggaatggggcggatgacctcaaatatactgccgaagaatgccttgcattttttattccatccgatgagaatgccgaaggaaataccaaaggcccatgcgataagcagtgccatgagtacacgccttaagctggcccatgcatgtcctgccagggaggtctttgcaatgggtttggtaaatgttttcacaaaacgtgcccatacgtcagccggggcaggcatcagctccgggtgactgcccgagaacagaacccagcccactgcaatcatcaggattgccagtacaggcaggccgtagtacaggacgtttttcagtgttttctgctgtttgcttgctacatccatattccttactccctcctacctgtttaccttccagcgcaggaaatatttttccgccctggacaaaaatcctgaaagaatggctccgatggcgccaatcaccaccatacccacgattacgatatccgggcgggccactgtacggccaatctgaatcatatatcccagtcccgcgctggctgccagcatctctgccgccaccagggtggaccaggaatttcccaaagccacacggattccggcaaataccatgggaagggaggaaggcacccccactttccagaatatctccgcattggaggccccgaaggtcctggatacattgattaacgtcttgttggtcagctttatgcctgtataggaattgatgacgcacggcacaaaggcggtaaaaaagataatgagagcctttgccttcagcccaattcccatccacaccactaccaggggtatccaggcaatggggggaaccggcctcaccagctcaaagatgggacggatgaaacggtccgcataggtccaccagcccatgaccagccccaggggaacgccgatgatgatggctgccaggaaaccggataaggcaacctggaggctggccagtatattcacccaaaggacgttgccgtccggggccttattcgcaaacttatacatcagggtctcaaaaatctgagtgggtgcgggaagcatcctttcattgacaagacccaggcttactaccagctgccacacggccagaagcgtgatgatgcctgccgcgcttaacagggcgtaattcaggccttcctttgatttctgctttttccactccaaaaggccagcctctaatttctcatttccagttgccatatcggtatctcaactcctttttaatttgcggtttcggtcagaacctcatttaacagctttccatccgtatgtcccacgaatctctcctggtcgccttccttatagttgcccacgctgatgaagaaatcaagtacgtctaaaagcctctggtccataactgaatggtcggaaccctctgccttgtcatttaacatgccgcatgcctcctgaagtgtgtaatatgtatcggcctccagatattttgcggttgtctccctgtccatggagcttccgttctcatcgttcatgtccacgcagtagtcaatggccttttccttgttctccttcatccagtccatggtcttaaagtacacttccataaacaccttcatggcctcatacttatccgggtcggcatagctgttcttattcgccacaaagctgcacatcagaccggaatccgccatgggaccgctggccacaggtatatacttatcggattcagccagcatcttgaaggttccccctgctcctgtcagcacgcacacatcgccttcgcctgccaggaatgcgctgtaagccgtagccgggtccatggcgataaagttcacatcgtcaaccgtaagtccaaagccttccagtaccttaatcagcacatactgggtaacgctgcccgtgttgcacaggatggattttcctttccagctgtccgcgtccccgtagatctcatcgctcagactgttatgtcccttgccggccttcacgatatctgaatcatttctggcaaatacatactgtgttccgtcgtccgtattactggatccaaggaccagcgcatcgtatcccagaacgccggcaaaaacgccgcccacgccggtgcagccgatatcccagccgtcagatgaaagagattccatctgcaccgggccgttggtaaacagcacctcctcaatatccagtcctttttccttaaaccagccttcctgctccgcaatatagataggaaggtaattaaggctgcccccaatgcccgaaaccgtaagctcgtaactcttgtccgctgttttgctgtcacctgttcccggtgcctcagcctgtgtatccgctttcttggattctgaaccagctccgcagcctgataccatcccggcacacatgactgctgccattgtgactgccaatgtctttactaatgattttctcataacgtttgacctcctgtccccaaatggttctcttatttttgctacatgtttttgcgtaataaacagccgcctttatcctttataaaagttgcatatttttttcattattttcgttaaatagttaacatttacatcattcagacagcatgcatttgcggtatactatttatttttgactatttattacccaacttgcaaagtcattatagcaatatgaccatttcaaggcaaggcaattcaaaccaaacgtttgcgtaccaaaaccccttgaaaaaacattgatattccatgattcttcccttcttctcctggtttttcccaggcatttttttacgcaaacgtttgtgtattattttatagtattccatgctcattttttgtatactaaaggcaaatagattgaaacatttgccttcaatgccccataagaggagggtagacatgacattaaaagaaatcgcccgggaagcaggggtatccatctccactgtttcccgggtcataaacaaaaatagcaccaatgttgccagcaaggaagtccaggaccgcatctgggagattgtgcgccgtaccggatatactcccaacgccacggcccgcagtctgaaaacaggcgcagctaaagccgcagactcccccacccgctccattgcctgcctttacgccagggctgaagattccaactcggacctgtttttctccacgctggcacgcagcatcgaaaaggaagccttcaaacacaactacgtgttaaaatactcctttaccggcattgacattcatcaccccaatacattccgcctcataacggataaccatgtggacggcgtggtggttcttggacggtgcgacaaacagaccctgagctttttaaaaaaatattttaactgcgtggcctatacagggctcaacctgttggaagccaagtacgaccaggtaatctgcgatgggtaccaggccagcctggccgccatgaacaccctccttggcctgggccatacaagaatcggcttcataggggaaacacagtttgaggataggtacacaggctactgcgctgcccttagcgcccataatctgcggccggccaagtcctacatcgtcaacgttcccctgtcctccgagggaggatacaagggggccaaggagcttctgtcccgcaaaaccgacgtgtccgccgtattctgctgcaatgacaacacagccataggcgccatgagagccatcaaggaagccgggctggtgattcctgacgacctctccgtcatcagcatcgacgacatagacacggcccagtatctgtcccccatgctcaccacgatccacatacccgtggaagagatgggacagatgacagcaaaaatcctcattgaccggattgaggaaggccataagcttcctatcaagatgaaccttcccttctatctggccaacagggaaagctgtgccccctatgccgaaaaggcgcagggcccggaacacgaacatacaataccaagaaaagaggaataaaccatgctgattacacttacggattccaaaacaactgctgtcattgattccacgggcgcccagctcatttccctgaaagacccttccggccgtgaatacatctggcagcgggacccaaaattctggaaaaaatgctccccgctcctgtttcccgtagttggcaactgccgaaacgacaggaccatactggaggaccgcatatatgccattgaaaaacacggattctgccgcgaaagggactttgatgtgtcacaaaaatccccgtcaaaagcagtattctcaatggatgacacaccggacacccgcagagcatacccatacaccttctgcctctccctgacatatgagcttaaggacggcatgctgtccatggaatatcaggtggaaaacagggaccagcgggccatgtggtatgccatcggcgcccatccgggatttaactgtcccatggaggatggctttgcctttgaggattaccagctggtatttgaaaaggaggaagacgctgtcagcatcccctatgatttggaccagctgcacttttccccctccagacagggaatcaggctgaagggctgtaccctttccctaaaccgtgaaatgtttaagaatgacgctgtattttttgataagctgaactcccggatggtatccattcttaatccggccacgggccggggtgtggaggtgggatttcccggctttgaaaccgttgccttctggaccctgtacccggaaccggccccatacctctgcgtagagccctggaacggatccggcatctacgaaaacgaggacgaccagctctcccacagacaccacatacagcacctcctcccgggggacaggcgcagttatgtcatgactatacgaatcctgggataattttcctcaaaattaaataatcatataataaaaaccggctctgcagttcattatgatgaatgcagggccggtttttaaccctcgtattgcgtccgcgtcctattccgcgattacaccttctgaaactaaccagttttcagcgtcatcccctggaaaaaacaataaaaatcccacagtagacacagcacctgcgtatgccgtcttatgcagggagtgcagctgtcataagagatggatttaaacccttacttttgctatactcagttatatccgatacctccctttatcccccactatttaacccccgaatttccccggctaatccttcggcatttagcgacatattttatcgttttttgtcgtcctgtctaacttgaaaaaacccccatacccggtttaactttacaggagtcaaagatatctggaggaatcatcatgaaatacgaaagagaaacctgcaacctgcttcggcgcctcggcgtcaacaactcctacgtggggttccgctacacagtttatggtgtcatccgcgctattgccaatccggaactgctcatttacatttccaaagggctttacgtggaaatatccgcggaatatcgtacatccatcggctgtgtggaacgcaatatccgcaccatcatcagcaccatatggctgcatggagaccgtactcttctgaaccaggtcttcggcttcgagttggaacagaagcctcgaaacggcgccttcatagatgcgctctctcactatgttgtagaacactattacgactgattctgtaaaatatatttagggtatccgtccgcttattctaaggtcatgattttacaaaatcataaaaagagaagggaggccaggcccggtgaccatcgggtctgtttgctgtgctcatatatagtgtctttttagaaacaaaaaaagccctgcaaatacaggactcttacgtatgcggctaacaggactcgaacctgcacggtttcccaatgggacctaaacccatcgtgtctgccaattccaccacagccgcaaatataaaaaatgcgggtggccggacttgaaccggcacggtatcgctaccgagggattttaagtcccttgtgtctgcctattccaccacacccgcagattgttacataacacagccatatgctgatataaaacaaatggggcctacagggctcgaacctgtgaccctctgcttgtaaggcagatgctctcccagctgagctaagaccccaaattgcatatgttgtatcgcattataaaatgcaaacgacccggaacgggttcgaaccgtcgacctccgccgtgacagggcggcgctctaaccagctgagccaccgggccattatttagataatatagttctcattctgctttagttaggaagagtggaccttcggggactcgaacccaggaccgaccggttatgagccggttgctctaaccaactgagctaaaggtccgaactatataatctctaacattgtttactgttttacagtaaaagccgatgatcggactcgaaccgataacctgctgattacaaatcagctgctctgccaattgagccacatcggcgtatcataaactggtcaaatgaccccaacgagattcgaactcgtgttaccgccgtgaaagggcgatgtcttaaccgcttgaccatggggcctgaataaggtagtggtcgccatggacttccactaaaactccccgagtaggacttgaacctacgacagcgcggttaacagccgcgtgctctaccgactgagctatcgaggaataaaatgatacgcttattgcactttgcgctgaccaaatcattatacaataactttgccaaaatttcaagcacaattataactttttacgtaccctcaaaaccacatattgaattccgattgtttacaaaccttttcttcccttaaccttttggataagccctcgaccgattagtattagtcagctccatacattactgcacttccacctctaacctatctacctcgtcgtcttcaaggggtcttactcgctttcgcgatgggatatctcatcttgaggggggcttcacgcttagatgccttcagcgtttatcccgtccagacttggctaccctgccatggccttggtaagccaacaggtacaccagcggtctgtccatcccggtcctctcgtactaaggacagctcctctcagatatcctacgcccgcgccggatagggaccgaactgtctcacgacgttctgaacccagctcgcgtaccgctttaatgggcgaacagcccaacccttgggacctgctacagccccaggatgcgatgagccgacatcgaggtgccaaaccactccgtcgatgtgaactcttgggagtgataagcctgttatccccagggtagcttttatccgttgagcgatggcaatcccactttcataccaccggatcactaagtcctactttcgtacctgctccacccgtcggtgtcgcagtcaagctcccttatgcctttgcactctttggatggtttccaaccatcctgagggaacctttgagcgcctccgataccctttcggaggcgaccgccccagtcaaactccccgcctgacattgtcccccgcccgggtcacgggcgcaggttagaaacccaatatcgcaagggtggtatcccaacattggctccacacagactggcgtccatgtttcttagcctcccacctatcctgtacatgcaataccgaatcccagtatcaaactggagtaaagctccatggggtctttccgtcctggcgcaggtaaccagcatcttcactggtatttcaatttcaccgggtgcattgttgagacagcgctcaaatcattacgcctttcgtgcgggtcggaacttacccgacaaggaatttcgctaccttaggaccgttatagttacggccgccgtttactggggcttaaattcaaagcttcgattgctctaacctctcctcttaaccttccagcaccgggcaggcgtcagcccatatacctcaccttacggttttgcatagacctgtgtttttgctaaacagttgcttgagcctattctctgcggccacatctctgtggcaccccttctcccgaagttacggggtcattttgccgagttccttaacaatgcttctcccgccggccttaggattctctcctcatctacctgtgtcggtttacggtacgggcatgtatcacacaatagcggcttttcttgacagccggaatcacacacttcgctactttagttcgctgcgcgtcacgtcttcggattgcacggcggatttgccaaccgtactcctacctcgcttgccccggtattcccattcccgggatgtgttgtccttctgtgtccccacagttctgatgatacatggtacaggaatttcaacctgttgtccatcgactacgcctctcagcctcgccttaggccccgacttacccagagcagatcagctttactctggaaaccttggatattcggcctggaggattcccacctccatctcgctactcattccggcattctctcttctcagcactccacggctccttatcggtaccgcttctccgtcctgagaatgctcctctaccaatgtacttacatacattcctaagcttcggtgttgtgtttcagccccggacattttcggcgcaggacctctcgactagtgagctattacgcactctttgaatgtgtggctgcttctgagccaacatcctagttgtctttgaaatcccacatccttttccacttaacacacactttgggaccttagctgtaggtctgggctctttcccttttgactacccaacttatctcgtgcagtctgactcccatacatcatttatgcggcattcggagtttgatatcccttggtaagctttgacgcccccttaggaattcagtgctctacctccgctaaactaatatgaggctagccctaaagctatttcgaggagaaccagctatctccgggttcgattggaatttctcccctatccacacctcattcccacccttttcaacggatgtggatccggtcctccacggaattttacttccgcttcaacctggacatggataggtcacccggtttcgggtctgcctgtactgacttgacgcccatttgagacttggtttcccttcggctccgagccttcagctcttaaccttgccagtaccggcaactcgccggaccgttctacaaaaagtacgcggtcgcaccttaacgtgcttccacagcttgtaaacacagggtttcaggttctttttcactcccctcccggggtccttttcacctttccttcacagtactatgcgctatcggtcactaaggagtatttagccttggagggtggtccctccgacttcccacaaggtttctcgtgtctcgtggtactctggatcctgctgcttcctattgctttcgtgtacggggctttcaccctctatggcctgacttcccagacagttccactaacaaatcggttcacgtttgcagtccttaaccccagcatgcacgcacgctggtttgggctcttcccatttcgctcgccgctactttgggaatcgatgtttctttctcttcctccggctacttagatgtttcagttcaccgggttccctctgcatggctatggattcaccatgcagtgactgaggtttgctcagccgggtttccccattcagatatctccggatcaaaggatatttgctcctccccgaagcttttcgcagcttatcacgtctttcatcggctcttagtgccaaggcatccaccctgcgctctttatagcttaaccaaatgatttcccgccgcgggttgctgcgggtcctccaaacgtccatagcgttggacgctttggttctaggttttcataaacgctttcgcatttacaagtttgtttcttccatacaatctcttgtatggcctcggatgtcttgatattctgatttgaatattcaattcatttttattcaatatgcggttttcaaggtacgtttggtatgcttccgtttcctctgaggtttcagcataagcttcttccttttggtcacttcagcaaatggagatggagagattcgaactcttgaccccctgcttgcaaggcaggtgctctcccaactgagctacacccccatagaaatctggcacccacctgctctcccatgccgtctccagcatagtaccatcggccgcttaggtcttaaccatcgtgttcgggatgggtacgggtgtttcccctaagcgcatcggcaccagaaattctttgtgtccttttcattgaacactagacagtatataaaacccttacttcttcttccttagaaaggaggtgatccagccgcaccttccgatacggctaccttgttacgacttcaccccagttacctgccccgccttcggcagctccctctcttgcgagttgggtcactgacttcgggcgttgctgactcccatggtgtgacgggcggtgtgtacaagacccgggaacgtattcaccgcgacattctgattcgcgattactagcgattccagcttcgtgtagtcgggttgcagactacagtccgaactgggacgttatttttgggatttgctccacatcactgtcttgcttccctttgtttacgccattgtagcacgtgtgtagcccaaatcataaggggcatgatgatttgacgtcatccccaccttcctccaggttatccctggcagtctccctagagtgcccagctctacctgctggctactaaggataagggttgcgctcgttgcgggacttaacccaacatctcacgacacgagctgacgacaaccatgcaccacctgtctctcctgccccgaagggaaggcgccgttacacgccggtcaagaggatgtcaagacttggtaaggttcttcgcgttgcttcgaattaaaccacatgctccaccgcttgtgcgggtccccgtcaattcctttgagtttcattcttgcgaacgtactccccaggtggaatgcttactgcgtttgcgacggcaccgaagggctttgccccccaacacctagcattcatcgtttacggcgtggactaccagggtatctaatcctgtttgctccccacgctttcgagcctcaacgtcagttatcgtccagtaagccgccttcgccactggtgttcctcctaatatctacgcatttcaccgctacactaggaattccacttacctctccgacactctagcaaaacagtttccaaagcagtcccagggttgagccctgggttttcacttcagacttgcttcgccgtctacgctccctttacacccagtaaatccggataacgcttgccccctacgtattaccgcggctgctggcacgtagttagccggggcttcttagtcaggtaccgtcattttcttccctgctgatagagctttacataccgaaatacttcttcactcacgcggcgtcgctgcatcaggctttcgcccattgtgcaatattccccactgctgcctcccgtaggagtttgggccgtgtctcagtcccaatgtggccggtcaccctctcaggtcggctactgatcgtcgctttggtgggccgttaccccgccaactggctaatcagacgcggatccatctcacaccaccggagtttttcacaccgtaccatgcggtactgtgcgcttatgcggtattagcagtcatttctaactgttatcccccagtgtgaggcaggttatccacgcgttactcacccgtccgccactcagtcaatcaaaaatccatccgaaaacttcattttaattgcttcgttcgacttgcatgtgttaggcacgccgccagcgttcatcctgagccaggatcaaactctcatgtttaaaagttgattccaggtttcagactacttagcttggctagttatctttaaccttcattacttggttttgttctgaattttctcaaatccaaaggcctaaaccagaccttttgtttttagaattttcagggttttacatactgtctaatcttcaattatcaaggttctttgttgtcggcttgttcagcagcaacttttatatcttatcacagtcgcttgtgtttgtcaacaacttttttaacttttttatttcttactctcttgcgcttttggtactcaccgcagcgcaagagatatcttaccagatgcttcaacaaatgtcaacaggttttttcaacttttttcattttttgcatttttctatattcaacctgtttcaatccctaagatttccctggtttaaccggcttaaatccgacatgacagaacgcataaacaagggattctttttatattcatccatattgctttcctcacatatcaactcaaatagcctgtgagtgctttcttcccccatacggcctctgtattcttctgtacatctcctgatcttagatatccttgaaagtccctcatgaatcatggctatccccgttcttctgtcataaaccttatcccatgcaggacaatacatatcaacctcctccaatagttccagacgttttaaggtatcctcactggcatgggaatcttcataaatcaaagcatctgatggctccggtatggaatctccggtaaaaagaattttctgttccctgtaataaaagcacaatgattctctggagtggccgggtgcacctattacctgaatggtaatccccggttccaggcacagcagatccccgtcagacaagatacggtccaccgtaacagaaccatccaccagactataatagccaggtatgggccgtttctcatattgaaggtctatatcctcaatccaatcccgctctcccctgctggcatatacgcagcaggaatacatttcctttatggtttttagggcaccaatatggtccggatgggaatgggtcaacagtacagcatttatattttctctgttttttccaattttatgtatatattcctcaatttttttatcacatccttttacccctgcgtcaaccaggtaacatccttcctttcctgttatgatatacacatagacatatctcgtgatttcaggtgtaatattaaactgaacgcgcagctgatgaactctgtcatttatcttcatcccattctcctctctctcttatcactgtaatccccatacctctcccctgccgtgacaataatggcctggctgtccactgtattttcccttttactcatgatttttctgtatttctctgaggaaaaacaccggtctatgctctccctgtccggaaaccatatcataatgaagcggtccggatgccagtctttccctatatattcaatcccttcgctcctcaccacatattttcctccgtattcctccacaataggcttgaccagttttatgtaatcgtcgtaatctgcccggtcctttcctggctccagaaaaacagaaataataaagtaacagctcatatcttctcctttctacgcaagtgtacgcttgcataactgttaaaaataaatggcaccgcatggtaccatatatttatgtatttacttggccaccccatggacaaatgcatctgccattttaataatatactcatctgcttccatctcagtcaggccgctgccaaaagaggccttaaaaaatacaaatccaaaattcaacgacaaaaacatcatggccatactctcataatcatccgatatgagctttcccttctcatacattttcctgaaatatgccgtaacaccggttttaaagacctggggaatggctaaaatcccttcccttgtatcctccgccagctctggtgtacgcagtcccagggagagcttaacaaattccggcgtgacctttttcatataaatacgggcaaattggcacaggtcctcagtcagattaccagtctcaatcataaaatcatccggttccaaatccggatgccatcttttctgtcccatggcctgaagcacaatttccttcttccccttaaattttctgaagatggtacactcgttcaccccggcacgttttgcgatatcctttgtagtggtggctgtatatcctctctccactacaagttccatggctgcatctataatattctgtcctgtctggtccatatcaccctccccaaaacgcaagtgtatacttgcatcatacaataatcccttctccatgtcaaggcttcctgtcacaaaaaggtcaagctgttcattattccctccgtatccagggacgatatagagccgccgaacataaccatctgcagtctgtctccattgattctggcataaaccttcaaaaatccggggatgcccagggaagatgcatccatataatgataactgtaccagagtccgtttgaaagctgcctggttgtcttggtctggggtgtccccaactctgcttccacagctgcatccagtacactttcctggtaggtgtataccaggtctgcatatccgccaaagtccgcaagggattctgacatgatgcagataaggctgctgccgtccgcactggtcatatatattcccctctcatcagaggaatgaaatacaaaatcttcgggaactgtgagaagtacattgccaatctgttttattgcgccgctgtcctgactctgctcctgcacacctgtcggctcctgttggggcacttccacctgttcctgcatctgcgcctgaacctcctgctgcatctgtaccactccgccctcaatccaggccccctgaccgtcaacgctgtacccatccggtgtttgagtgttttggagacagtagccatccgcattaaaatagtagcatcttccgtctatccaggaccattcgctttttacatacgtgccatcctcattctgataccaccagccggtatcgtcttgcctccactggcctgcaaacgcgctcatactcaaagctacagtggccagcagcaccgcaattaccatcatccggcattttttcctaccggcggcgctcttatcccttattctcatatcagttgccctccctcagtcttatacttccaatatactttgcttttccggggacaagaacctaaaatcaacttaaattatatttctggatggaaaatataaaaacacaaaaaaaccggagcaccctgtatcataaaatcacaaagctccggttaaacaacaaaaaagcgcgagacgggattcgaacccgcggcccccaccttggcaaggtggtgctccacccctgagccactcgcgcataaatgttatcattatatttacaaagtcggggtgacaggattcgaacctgcgacctcctggtcccaaaccaggcgctctagccaagctgagccacaccccgtcatcaccgtgtacataaatatatcacagatgatattaaatttcaagtacttttacgtaccctc

SEQ ID NO: 8 - skipped
